US012781184B2

(12) United States Patent
Abe et al.

(10) Patent No.: US 12,781,184 B2
(45) Date of Patent: Nov. 3, 2026

(54) METHODS OF GENERATING MATURE CORNEAL ENDOTHELIAL CELLS

(71) Applicant: Astellas Institute for Regenerative Medicine, Westborough, MA (US)

(72) Inventors: Masashi Abe, Newton, MA (US); Janmeet Singh Saini, Framingham, MA (US); Nikolaos Giagtzoglou, Waltham, MA (US)

(73) Assignee: Astellas Institute for Regenerative Medicine, Westborough, MA (US)

( * ) Notice: Subject to any disclaimer, the term of this patent is extended or adjusted under 35 U.S.C. 154(b) by 360 days.

(21) Appl. No.: 18/289,363

(22) PCT Filed: May 2, 2022

(86) PCT No.: PCT/US2022/027335
§ 371 (c)(1),
(2) Date: Nov. 2, 2023

(87) PCT Pub. No.: WO2022/235586
PCT Pub. Date: Nov. 10, 2022

(65) Prior Publication Data

US 2024/0368541 A1 Nov. 7, 2024

Related U.S. Application Data

(60) Provisional application No. 63/183,562, filed on May 3, 2021.

(51) Int. Cl.

| | |
|---|---|
| ***C12N 5/079*** | (2010.01) |
| ***A61K 35/30*** | (2015.01) |
| ***A61P 27/02*** | (2006.01) |
| ***C12N 15/86*** | (2006.01) |

(52) U.S. Cl.
CPC ............ *C12N 5/0621* (2013.01); *A61K 35/30* (2013.01); *A61P 27/02* (2018.01); *C12N 15/86* (2013.01); *C12N 2500/38* (2013.01); *C12N 2500/84* (2013.01); *C12N 2501/115* (2013.01); *C12N 2501/155* (2013.01); *C12N 2501/60* (2013.01); *C12N 2506/45* (2013.01); *C12N 2740/15043* (2013.01)

(58) Field of Classification Search
None
See application file for complete search history.

(56) References Cited

U.S. PATENT DOCUMENTS

| | | | |
|---|---|---|---|
| 4,959,319 | A | 9/1990 | Skelnik et al. |
| 5,166,048 | A | 11/1992 | Soll et al. |
| 5,269,812 | A | 12/1993 | White |
| 5,310,728 | A | 5/1994 | Shimizu et al. |
| 5,584,881 | A | 12/1996 | Rowsey |
| 5,589,451 | A | 12/1996 | Wilson |
| 5,649,944 | A | 7/1997 | Collins |
| 5,686,414 | A | 11/1997 | Scannon |
| 5,703,047 | A | 12/1997 | Wilson |
| 5,755,785 | A | 5/1998 | Rowsey et al. |
| 6,541,256 | B1 | 4/2003 | Chen et al. |
| 6,548,059 | B1 | 4/2003 | Joyce et al. |
| 7,147,648 | B2 | 12/2006 | Lin |
| 7,300,653 | B2 | 11/2007 | Wiegand et al. |
| 7,300,654 | B2 | 11/2007 | Wiegand et al. |
| 7,371,513 | B2 | 5/2008 | Steinhardt |
| 7,959,939 | B2 | 6/2011 | Yamagami |
| 8,642,334 | B2 | 2/2014 | Chambers et al. |
| 8,889,415 | B2 | 11/2014 | Tsai |
| 9,096,832 | B2 | 8/2015 | Xu |
| 9,347,041 | B2 | 5/2016 | Hayashi et al. |
| 9,347,042 | B2 | 5/2016 | Shimmura et al. |
| 9,376,661 | B2 | 6/2016 | Shima et al. |
| 9,752,118 | B2 | 9/2017 | McCabe et al. |
| 10,260,041 | B2 | 4/2019 | Chambers et al. |
| 10,287,546 | B2 | 5/2019 | Chambers et al. |
| 10,287,547 | B2 | 5/2019 | Ding et al. |
| 10,501,725 | B2 | 12/2019 | Shimmura et al. |
| 12,049,642 | B2 | 7/2024 | McCabe et al. |
| 2005/0214259 | A1 | 9/2005 | Sano et al. |
| 2006/0068496 | A1 | 3/2006 | Kelly |
| 2006/0100612 | A1 | 5/2006 | Van der Heyd et al. |
| 2006/0216821 | A1 | 9/2006 | Totey et al. |
| 2006/0228693 | A1 | 10/2006 | Soll |

(Continued)

FOREIGN PATENT DOCUMENTS

| | | |
|---|---|---|
| EP | 2532738 B1 | 12/2012 |
| EP | 2013334 B1 | 8/2016 |

(Continued)

OTHER PUBLICATIONS

Chen et al Directed Differentiation of Human Corneal Endothelial Cells From Human Embryonic Stem Cells by Using Cell-Conditioned Culture Media. Investigative ophthalmology & visual science, 59(7), 3028â3036. https://doi.org/10.1167/iovs.17-23627 (Year: 2018).*
Okubo et al (2020). Generation and validation of a PITX2-EGFP reporter line of human induced pluripotent stem cells enables isolation of periocular mesenchymal cells. The Journal of biological chemistry, 295(11), 3456-3465. https://doi.org/10.1074/jbc.RA119.010713 (Year: 2020).*

(Continued)

*Primary Examiner* — Allison M Fox
*Assistant Examiner* — Caroline M Lara
(74) *Attorney, Agent, or Firm* — Wolf, Greenfield & Sacks, P.C.

(57) ABSTRACT

The present invention provides methods of generating corneal endothelial cells, for example mature corneal endothelial cells, by increasing expression of a transcription factor in corneal endothelial progenitors, and compositions thereof.

20 Claims, 7 Drawing Sheets

Specification includes a Sequence Listing.

(56) References Cited

U.S. PATENT DOCUMENTS

| | | | | |
|---|---|---|---|---|
| 2006/0240552 | A1 | 10/2006 | Yamato et al. | |
| 2006/0257382 | A1 | 11/2006 | Williams et al. | |
| 2007/0092550 | A1 | 4/2007 | Lui | |
| 2007/0128722 | A1 | 6/2007 | Lin et al. | |
| 2007/0148137 | A1 | 6/2007 | Okano et al. | |
| 2007/0207127 | A1 | 9/2007 | Kato et al. | |
| 2007/0254361 | A1 | 11/2007 | Tsai | |
| 2007/0275365 | A1 | 11/2007 | Lui | |
| 2008/0124276 | A1 | 5/2008 | Hammond et al. | |
| 2008/0214614 | A1 | 9/2008 | Lampe et al. | |
| 2009/0222086 | A1 | 9/2009 | Lui et al. | |
| 2009/0232772 | A1 | 9/2009 | Amano et al. | |
| 2009/0263465 | A1 | 10/2009 | Hsiue et al. | |
| 2009/0270982 | A1 | 10/2009 | Torres et al. | |
| 2010/0003299 | A1 | 1/2010 | Tseng et al. | |
| 2010/0022517 | A1 | 1/2010 | Richards et al. | |
| 2010/0069915 | A1 | 3/2010 | Shiuey | |
| 2010/0184033 | A1 | 7/2010 | West et al. | |
| 2010/0184221 | A1 | 7/2010 | Yokoo et al. | |
| 2010/0209402 | A1 | 8/2010 | Koizumi et al. | |
| 2010/0215717 | A1 | 8/2010 | Soker et al. | |
| 2010/0233240 | A1 | 9/2010 | Koizumi et al. | |
| 2010/0297234 | A1 | 11/2010 | Sugino et al. | |
| 2011/0009488 | A1 | 1/2011 | Bazan et al. | |
| 2011/0143415 | A1 | 6/2011 | Paylian | |
| 2011/0166650 | A1 | 7/2011 | Busin | |
| 2012/0028933 | A1 | 2/2012 | Baust et al. | |
| 2012/0149598 | A1 | 6/2012 | Inoue et al. | |
| 2012/0207744 | A1 | 8/2012 | Mendlein et al. | |
| 2012/0219535 | A1 | 8/2012 | Maxson, Jr. et al. | |
| 2012/0282318 | A1 | 11/2012 | Nishida et al. | |
| 2012/0288482 | A1 | 11/2012 | Takahashi et al. | |
| 2013/0023050 | A1 | 1/2013 | Shima et al. | |
| 2013/0108590 | A1 | 5/2013 | Takahashi et al. | |
| 2013/0302824 | A1 | 11/2013 | Klimanskaya et al. | |
| 2014/0170751 | A1 | 6/2014 | Hayashi et al. | |
| 2014/0314723 | A1 | 10/2014 | Yim et al. | |
| 2016/0266114 | A1 | 9/2016 | Koizumi et al. | |
| 2017/0065642 | A1 | 3/2017 | Hammond et al. | |
| 2017/0253855 | A1 | 9/2017 | Nishida et al. | |
| 2018/0010093 | A1 | 1/2018 | Nishida et al. | |
| 2018/0055891 | A1 | 3/2018 | Zhao | |
| 2018/0072989 | A1 | 3/2018 | McCabe et al. | |
| 2018/0104046 | A1 | 4/2018 | Gutermuth | |
| 2019/0119633 | A1 | 4/2019 | Zhao et al. | |
| 2019/0249140 | A1 | 8/2019 | Chambers et al. | |
| 2020/0010800 | A1 | 1/2020 | Nishida et al. | |
| 2020/0063105 | A1 | 2/2020 | Ng et al. | |
| 2020/0101200 | A1* | 4/2020 | Nishida .................. | A61K 35/28 |
| 2024/0409892 | A1 | 12/2024 | McCabe et al. | |

FOREIGN PATENT DOCUMENTS

| | | | |
|---|---|---|---|
| EP | 2765188 | B1 | 12/2017 |
| EP | 2049043 | B1 | 10/2018 |
| EP | 2788472 | B1 | 2/2019 |
| JP | 2005-229869 | A | 9/2005 |
| JP | 2009-268433 | A | 11/2009 |
| JP | 2009-544313 | A | 12/2009 |
| JP | 6041270 | B2 | 12/2016 |
| JP | 6226349 | B2 | 10/2017 |
| JP | 2018-512930 | A | 5/2018 |
| JP | 2018-158937 | A | 10/2018 |
| JP | 6465898 | B2 | 1/2019 |
| JP | 6548576 | B2 | 7/2019 |
| JP | 2019-530438 | A | 10/2019 |
| JP | 2019-530439 | A | 10/2019 |
| WO | WO 2022/235586 | A1 | 11/2002 |
| WO | WO 2007/127975 | A2 | 11/2007 |
| WO | WO 2008/013557 | A1 | 1/2008 |
| WO | WO 2009/028632 | A1 | 3/2009 |
| WO | WO 2010/096496 | A2 | 8/2010 |
| WO | WO 2010/140698 | A1 | 12/2010 |
| WO | WO 2011/041062 | A1 | 4/2011 |
| WO | WO 2011/149762 | A2 | 12/2011 |
| WO | WO 2012/012803 | A2 | 1/2012 |
| WO | WO 2013/051722 | A1 | 4/2013 |
| WO | WO 2013/100208 | A1 | 7/2013 |
| WO | WO 2013/086236 | A1 | 8/2013 |
| WO | WO 2014/007402 | A1 | 1/2014 |
| WO | WO 2014/179716 | A2 | 11/2014 |
| WO | WO 2015/080297 | A1 | 6/2015 |
| WO | WO 2016/093359 | A1 | 6/2016 |
| WO | WO 2016/129654 | A1 | 8/2016 |
| WO | WO 2016/150652 | A1 | 9/2016 |
| WO | WO 2017/141926 | A1 | 8/2017 |
| WO | WO 2018/044795 | A1 | 3/2018 |
| WO | WO 2018/044809 | A1 | 3/2018 |
| WO | WO 2019/025984 | A1 | 2/2019 |
| WO | WO 2019/142833 | A1 | 7/2019 |
| WO | WO 2019/198086 | A1 | 10/2019 |
| WO | WO 2019/241705 | A1 | 12/2019 |
| WO | WO 2020/004652 | A1 | 1/2020 |
| WO | WO 2020/045642 | A1 | 3/2020 |
| WO | WO 2020/071438 | A1 | 4/2020 |

OTHER PUBLICATIONS

International Search Report for Application No. PCT/US2022/027335, mailed Aug. 9, 2022.

International Preliminary Report on Patentability for Application No. PCT/US2022/027335, mailed Nov. 16, 2023.

Alaoui-Ismaili et al., Design of second generation therapeutic recombinant bone morphogenetic proteins. Cytokine Growth Factor Rev. Oct.-Dec. 2009;20(56):501-7. doi: 10.1016/j.cytogfr.2009.10.001. Epub Nov. 11, 2009.

Bartakova et al., Novel Identity and Functional Markers for Human Corneal Endothelial Cells. Invest Ophthalmol Vis Sci. May 1, 2016;57(6):2749-62. doi: 10.1167/iovs.15-18826.

Blauwkamp et al., Endogenous Wnt signalling in human embryonic stem cells generates an equilibrium of distinct lineage-specified progenitors. Nat Commun. 2012;3:1070. doi: 10.1038/ncomms2064.

Bowie et al., Deciphering the message in protein sequences: tolerance to amino acid substitutions. Science. Mar. 16, 1990;247(4948):1306-10. doi: 10.1126/science.2315699.

Burgess et al., Possible dissociation of the heparin-binding and mitogenic activities of heparin-binding (acidic fibroblast) growth factor-1 from its receptor-binding activities by site-directed mutagenesis of a single lysine residue. J Cell Biol. Nov. 1990;111(5 Pt 1):2129-38. doi: 10.1083/jcb.111.5.2129.

Chen et al., Neutralization of mouse interleukin-17 bioactivity inhibits corneal allograft rejection. Mol Vis. 2011;17:2148-56. Epub Aug. 11, 2011.

Chiambaretta et al., Cell and tissue specific expression of human Krüppel-like transcription factors in human ocular surface. Mol Vis. Nov. 23, 2004:10:901-9.

Crane et al., Neural crest stem and progenitor cells. Annu Rev Cell Dev Biol. 2006;22:267-86. Abstract Only.

Da Silva et al., Smart thermoresponsive coatings and surfaces for tissue engineering: switching cell-material boundaries. Trends Biotechnol. Dec. 2007;25(12):577-83. Epub Nov. 8, 2007. Abstract Only.

De Araujo et al., Corneal stem cells and tissue engineering: Current advances and future perspectives. World J Stem Cells. Jun. 26, 2015;7(5):806-14. doi: 10.4252/wjsc.v7.i5.806. Review.

Fan et al., Establishment of a continuous untransfected human corneal endothelial cell line and its biocompatibility to denuded amniotic membrane. Mol Vis. Feb. 15, 2011:17:469-80.

Gage et al., Fate maps of neural crest and mesoderm in the mammalian eye. Invest Ophthalmol Vis Sci. Nov. 2005;46(11):4200-8. doi: 10.1167/iovs.05-0691.

Gage et al., The canonical Wnt signaling antagonist DKK2 is an essential effector of PITX2 function during normal eye development. Dev Biol. May 1, 2008;317(1):310-24. doi: 10.1016/j.ydbio.2008.02.030. Epub Mar. 4, 2008.

Gao et al., In vitro culture of human fetal corneal endothelial cells. Graefes Arch Clin Exp Ophthalmol. May 2011;249(5):663-9. doi: 10.1007/s00417-010-1547-y. Epub Dec. 21, 2010.

(56) References Cited

OTHER PUBLICATIONS

Gospodarowicz et al., Transplantation of cultured bovine corneal endothelial cells to rabbit cornea: clinical implications for human studies. Proc Natl Acad Sci U S A. Jan. 1979;76(1):464-8.
Guo et al., Protein tolerance to random amino acid change. Proc Natl Acad Sci U S A. Jun. 22, 2004;101(25):9205-10. doi: 10.1073/pnas.0403255101. Epub Jun. 14, 2004.
Gwak et al., Small molecule-based promotion of PKCα-mediated β-catenin degradation suppresses the proliferation of CRT-positive cancer cells. PLoS One. 2012;7(10):e46697. doi: 10.1371/journal.pone.0046697. Epub Oct. 5, 2012.
Hara et al., Transcription factor TFAP2B up-regulates human corneal endothelial cell-specific genes during corneal development and maintenance. J Biol Chem. Feb. 15, 2019;294(7):2460-2469. doi: 10.1074/jbc.RA118.005527. Epub Dec. 14, 2018.
Hasagawa et al., Wnt signaling orchestration with a small molecule DYRK inhibitor provides long-term xeno-free human pluripotent cell expansion. Stem Cells Transl Med. Jan. 2012;1(1):18-28. doi: 10.5966/sctm.2011-0033. Epub Dec. 7, 2011.
Hayashi et al., Immunologic mechanisms of corneal allografts reconstituted from cultured allogeneic endothelial cells in an immune-privileged site. Invest Ophthalmol Vis Sci. Jul. 2009;50(7):3151-8. doi: 10.1167/iovs.08-2530. Epub Feb. 28, 2009.
Hitani et al., Transplantation of a sheet of human corneal endothelial cell in a rabbit model. Mol Vis. Jan. 3, 2008;14:1-9.
Homma et al., Induction of epithelial progenitors in vitro from mouse embryonic stem cells and application for reconstruction of damaged cornea in mice. Invest Ophthalmol Vis Sci. Dec. 2004;45(12):4320-6. doi: 10.1167/iovs.04-0044.
Honda et al., Descemet stripping automated endothelial keratoplasty using cultured corneal endothelial cells in a rabbit model. Arch Ophthalmol. Oct. 2009;127(10):1321-6. doi: 10.1001/archophthalmol.2009.253.
Hoppenreijs et al., Effects of platelet-derived growth factor on endothelial wound healing of human corneas. Invest Ophthalmol Vis Sci. Jan. 1994;35(1):150-61.
Hsiue et al., A novel strategy for corneal endothelial reconstruction with a bioengineered cell sheet. Transplantation. Feb. 15, 2006;81(3):473-6. Abstract Only.
Hwang et al., Controlled differentiation of stem cells. Adv Drug Deliv Rev. Jan. 14, 2008;60(2):199-214. Epub Oct. 11, 2007. Review. Author manuscript.
Ide et al., Structural characterization of bioengineered human corneal endothelial cell sheets fabricated on temperature-responsive culture dishes. Biomaterials. Feb. 2006;27(4):607-14. Epub Aug. 15, 2005. Abstract Only.
Iida et al., FH535 inhibited migration and growth of breast cancer cells. PLoS One. 2012;7(9):e44418. doi: 10.1371/journal.pone.0044418. Epub Sep. 11, 2012.
Joyce et al., Age-related gene response of human corneal endothelium to oxidative stress and DNA damage. Invest Ophthalmol Vis Sci. Mar. 1, 2011;52(3):1641-9. doi: 10.1167/iovs.10-6492.
Joyce et al., Decreasing expression of the G1-phase inhibitors, p21Cip1 and p16INK4a, promotes division of corneal endothelial cells from older donors. Mol Vis. May 25, 2010;16:897-906.
Joyce et al., Proliferative capacity of corneal endothelial cells. Exp Eye Res. Feb. 2012;95(1):16-23. doi: 10.1016/j.exer.2011.08.014. Epub Aug. 30, 2011.
Ju et al., Derivation of corneal endothelial cell-like cells from rat neural crest cells in vitro. PLoS One. 2012;7(7):e42378. doi: 10.1371/journal.pone.0042378. Epub Jul. 31, 2012.
Koizumi et al., Cultivated corneal endothelial cell sheet transplantation in a primate model. Invest Ophthalmol Vis Sci. Oct. 2007;48(10):4519-26.
Koizumi et al., Cultivated corneal endothelial transplantation in a primate: possible future clinical application in corneal endothelial regenerative medicine. Cornea. Sep. 2008;27 Suppl 1:S48-55. doi: 10.1097/ICO.0b013e31817f2298. Abstract only.
Lai et al., Tissue-engineered human corneal endothelial cell sheet transplantation in a rabbit model using functional biomaterials. Transplantation. Nov. 27, 2007;84(10):1222-32.
Lee et al., Directed differentiation and transplantation of human embryonic stem cell-derived motoneurons. Stem Cells. Aug. 2007;25(8):1931-9. Epub May 3, 2007.
Li et al., Notch signal regulates corneal endothelial-to-mesenchymal transition. Am J Pathol. Sep. 2013;183(3):786-95. doi: 10.1016/j.ajpath.2013.05.025. Epub Jul. 12, 2013.
Li et al., Rapid induction and long-term self-renewal of primitive neural precursors from human embryonic stem cells by small molecule inhibitors. Proc Natl Acad Sci U S A. May 17, 2011;108(20):8299-304. doi: 10.1073/pnas.1014041108. Epub Apr. 27, 2011.
Lu et al., Enhanced survival in vitro of human corneal endothelial cells using mouse embryonic stem cell conditioned medium. Mol Vis. Apr. 8, 2010:16:611-22. doi: 10.1167/2.7.611.
Luo et al., Cloning, expression and functional analyses of human platelet-derived growth factor-B chain peptide for wound repair of cat corneal endothelial cells. Chin J Traumatol. Feb. 2009;12(1):31-7.
Mccabe et al., Efficient Generation of Human Embryonic Stem Cell-Derived Corneal Endothelial Cells by Directed Differentiation. PLoS One. Dec. 21, 2015;10(12):e0145266. doi: 10.1371/journal.pone.0145266. eCollection 2015.
Menendez et al., Wnt signaling and a Smad pathway blockade direct the differentiation of human pluripotent stem cells to multipotent neural crest cells. Proc Natl Acad Sci U S A. Nov. 29, 2011;108(48):19240-5. doi: 10.1073/pnas.1113746108. Epub Nov. 14, 2011.
Mimura et al., Transplantation of corneas reconstructed with cultured adult human corneal endothelial cells in nude rats. Exp Eye Res. Aug. 2004;79(2):231-7. Abstract Only.
Mimura et al., Treatment of rabbit bullous keratopathy with precursors derived from cultured human corneal endothelium. Invest Ophthalmol Vis Sci. Oct. 2005;46(10):3637-44.
Nagoshi et al., Neural crest-derived stem cells display a wide variety of characteristics. J Cell Biochem. Aug. 15, 2009;107(6):1046-52. doi: 10.1002/jcb.22213. Abstract Only.
Ng et al., PDGF, TGF-beta, and FGF signaling is important for differentiation and growth of mesenchymal stem cells (MSCs): transcriptional profiling can identify markers and signaling pathways important in differentiation of MSCs into adipogenic, chondrogenic, and osteogenic lineages. Blood. Jul. 15, 2008;112(2):295-307. doi: 10.1182/blood-2007-07-103697. Epub Mar. 10, 2008.
Nishida et al., Corneal reconstruction with tissue-engineered cell sheets composed of autologous oral mucosal epithelium. N Engl J Med. Sep. 16, 2004;351(12):1187-96.
Nishida et al., Functional bioengineered corneal epithelial sheet grafts from corneal stem cells expanded ex vivo on a temperature-responsive cell culture surface. Transplantation. Feb. 15, 2004;77(3):379-85.
No Author Listed, Useful Numbers for Cell Culture. Invitrogen. Retrieved from www.Invitrogen.com on Nov. 21, 2018. 1 page.
No Author Listed, Corning Cell Culture Selection Guide. Corning Incorporated. 2008. 52 pages.
No Author Listed, RefSeq NM_000371. TTR protein, human [Supplementary Concept]. Introduced: Mar. 13, 2019. 1 page. www.ncbi.nlm.nih.gov/mesh/2029136.
No Author Listed, RefSeq NM_000442. PECAM1 protein, human [Supplementary Concept]. Introduced: Jul. 29, 2019. 1 page. www.ncbi.nlm.nih.gov/mesh/2030237.
No Author Listed, Surface Areas and Recommended Medium Volumes for Corning Cell Culture Vessels. Corning Incorporated. 2012. 4 pages.
Okumura et al., Enhancement of corneal endothelium wound healing by Rho-associated kinase (ROCK) inhibitor eye drops. Br J Ophthalmol. Jul. 2011;95(7):1006-9. doi: 10.1136/bjo.2010.194571. Epub Mar. 11, 2011. Abstract Only.
Okumura et al., Enhancement on primate corneal endothelial cell survival in vitro by a ROCK inhibitor. Invest Ophthalmol Vis Sci. Aug. 2009;50(8):3680-7. doi: 10.1167/iovs.08-2634. Epub Apr. 22, 2009.

(56) References Cited

OTHER PUBLICATIONS

Pawson et al., Assembly of cell regulatory systems through protein interaction domains. Science. Apr. 18, 2003;300(5618):445-52. doi: 10.1126/science.1083653.
Peh et al., Human corneal endothelial cell expansion for corneal endothelium transplantation: an overview. Transplantation. Apr. 27, 2011;91(8):811-9. doi: 10.1097/TP.0b013e3182111f01.
Peh et al., Optimization of human corneal endothelial cell culture: density dependency of successful cultures in vitro. BMC Res Notes. May 3, 2013;6:176. doi: 10.1186/1756-0500-6-176.
Redmond et al., Age-related decrease in human corneal γ-glutamyltranspeptidase activity. Cornea. May 2013;32(5):e121-6. doi: 10.1097/ICO.0b013e3182656881. Abstract Only.
Schuldiner et al., Effects of eight growth factors on the differentiation of cells derived from human embryonic stem cells. Proc Natl Acad Sci U S A. Oct. 10, 2000;97(21):11307-12.
Senoo et al., EDTA: a promoter of proliferation in human corneal endothelium. Invest Ophthalmol Vis Sci. Sep. 2000;41(10):2930-5.
Shao et al., Bone marrow-derived endothelial progenitor cells: a promising therapeutic alternative for corneal endothelial dysfunction. Cells Tissues Organs. 2011;193(4):253-63. doi: 10.1159/000319797. Epub Oct. 20, 2010.
Sheerin et al., Characterization of cellular senescence mechanisms in human corneal endothelial cells. Aging Cell. Apr. 2012; 11(2): 234-240. doi: 10.1111/j.1474-9726.2011.00776.x.
Shimmura et al., Transplantation of corneal endothelium with Descemet's membrane using a hyroxyethyl methacrylate polymer as a carrier. Br J Ophthalmol. Feb. 2005;89(2):134-7.
Shin et al., Protective effect of clusterin on oxidative stress-induced cell death of human corneal endothelial cells. Mol Vis. Dec. 16, 2009:15:2789-95.
Sieber-Blum, Epidermal neural crest stem cells and their use in mouse models of spinal cord injury. Brain Res Bull. Oct. 30, 2010;83(5):189-93. doi: 10.1016/j.brainresbull.2010.07.002. Epub Jul. 14, 2010. Abstract Only.
Sugino et al., A method to enhance cell survival on Bruch's membrane in eyes affected by age and age-related macular degeneration. Invest Ophthalmol Vis Sci. Dec. 20, 2011;52(13):9598-609. doi: 10.1167/iovs.11-8400.
Sumide et al., Functional human corneal endothelial cell sheets harvested from temperature-responsive culture surfaces. FASEB J. Feb. 2006;20(2):392-4. Epub Dec. 9, 2005. 23 Pages.
Tchah, Heterologous corneal endothelial cell transplantation—human corneal endothelial cell transplantation in Lewis rats. J Korean Med Sci. Dec. 1992;7(4):337-42.
Wang et al., Derivation of smooth muscle cells with neural crest origin from human induced pluripotent stem cells. Cells Tissues Organs. 2012;195(1-2):5-14. doi: 10.1159/000331412. Epub Oct. 14, 2011.
Wang et al., High expression of p16INK4a and low expression of Bmil are associated with endothelial cellular senescence in the human cornea. Mol Vis. 2012;18:803-15. Epub Apr. 3, 2012.
Wilson et al., Hepatocyte growth factor, keratinocyte growth factor, their receptors, fibroblast growth factor receptor-2, and the cells of the cornea. Invest Ophthalmol Vis Sci. Jul. 1993;34(8):2544-61.
Yamaguchi et al., Adhesion, Migration, and Proliferation of Cultured Human Corneal Endothelial Cells by Laminin-5. Invest Ophthalmol Vis Sci. Feb. 3, 2011;52(2):679-84. doi: 10.1167/iovs.10-5555.
Yoshihara et al., Restricted Presence of POU6F2 in Human Corneal Endothelial Cells Uncovered by Extension of the Promoter-level Expression Atlas. EBioMedicine. Nov. 2017;25:175-186. doi: 10.1016/j.ebiom.2017.10.024. Epub Nov. 4, 2017.
Yu et al., Progenitors for the Corneal Endothelium and Trabecular Meshwork: A Potential Source for Personalized Stem Cell Therapy in Corneal Endothelial Diseases and Glaucoma. J Biomed Biotechnol. 2011:2011:412743. doi: 10.1155/2011/412743. Epub Dec. 6, 2011.
Zhang et al., Isolation and transplantation of corneal endothelial cell-like cells derived from in-vitro-differentiated human embryonic stem cells. Stem Cells Dev. Jun. 15, 2014;23(12):1340-54. doi: 10.1089/scd.2013.0510. Epub Mar. 10, 2014.
Zhao et al., A high-throughput screen for Wnt/β-catenin signaling pathway modulators in human iPSC-derived neural progenitors. J Biomol Screen. Oct. 2012;17(9):1252-63. Epub Aug. 24, 2012.
Hatou et al., Review: corneal endothelial cell derivation methods from ES/iPS cells. Inflamm Regen. Oct. 3, 2019:39:19. doi: 10.1186/s41232-019-0108-y. eCollection 2019.
Vaiciuliene et al., Risk factors for fluctuations in corneal endothelial cell density (Review). Exp Ther Med. Feb. 2022;23(2):129. doi: 10.3892/etm.2021.11052. Epub Dec. 10, 2021.
Patterson et al., Defining the nature of human pluripotent stem cell progeny. Cell Res. Jan. 2012;22(1):178-93. doi: 10.1038/cr.2011.133. Epub Aug. 16, 2011.

* cited by examiner

| | transcript | gene | Adult.CEC.31yr | Adult.CEC.56yr | Adult.CEC.64yr | Fetal.CEC. | Fetal.CEC.B |
|---|---|---|---|---|---|---|---|
| 41925 | NM_001453 | FOXC1 | 193.55 | 172.01 | 219.27 | 262.44 | 180.99 |
| 10054 | NM_153427 | PITX2 | 23.03 | 20.43 | 12.74 | 35.31 | 25.47 |
| 18909 | NM_001204398 | | 91.04 | 126.06 | 98.8 | 374.14 | 302.33 |
| 22901 | NM_001204397 | | 2.16 | 2.98 | 1.42 | 3.77 | 2.36 |
| 32342 | NM_001204399 | | 56.49 | 21.6 | 14.59 | 94.27 | 145.58 |
| 36510 | NM_000325 | | 219.85 | 170.11 | 161.02 | 366.78 | 223.65 |
| 37988 | NM_153426 | | 30.53 | 54.71 | 37.41 | 80.79 | 41.84 |
| 9564 | NM_003221 | TFAP2B | 189.31 | 113.11 | 88.02 | 364.36 | 231.15 |
| 1613 | NM_001174146 | LMX1B | 2.28 | 0 | 0 | 4.68 | 0 |
| 24521 | NM_002316 | | 243.12 | 183.54 | 197.63 | 280.78 | 120.65 |
| 37523 | NM_001174147 | | 81.67 | 22.26 | 32.42 | 73.12 | 36.86 |

FIG. 5

METHODS OF GENERATING MATURE CORNEAL ENDOTHELIAL CELLS

RELATED APPLICATIONS

This application is a national stage filing under 35 U.S.C. § 371 of International Application No. PCT/US2022/027335, filed May 2, 2022, entitled "METHODS OF GENERATING MATURE CORNEAL ENDOTHELIAL CELLS," which claims the benefit under 35 U.S.C. § 119 (e) of U.S. Provisional Application Ser. No. 63/183,562, filed May 3, 2021, entitled "METHODS OF GENERATING MATURE CORNEAL ENDOTHELIAL CELLS", the entire contents of each of which are incorporated herein by reference.

REFERENCE TO AN ELECTRONIC SEQUENCE LISTING

The contents of the electronic sequence listing (A102570063US01-SEQ-CBD.txt; Size: 1,054,926 bytes; and Date of Creation: Oct. 31, 2023) is herein incorporated by reference in its entirety.

FIELD OF THE INVENTION

The present invention relates to methods of generating mature corneal endothelial cells, and compositions thereof.

BACKGROUND

The cornea performs functions critical for normal vision and maintenance of eye health, including providing about two-thirds of the optical power of the eye and protecting the eye from injury or infection. Corneal disease and injury is a leading cause of blindness worldwide. Many corneal diseases and injuries can be treated by transplantation of donor corneas. The cornea is the most transplanted organ in the body and has a high success rate over 15 years. For example, approximately 40,000 corneal transplantations are performed per year in the U.S. However, demand for corneas for transplantation greatly exceeds the current supply worldwide, and the limited quality and quantity of available donor tissue hinders treatment. One factor contributing to the inadequate supply of donated corneas is that up to 30% of donated corneas are rejected for transplantation due to poor quality of the corneal endothelium. Quality of the corneal endothelium generally decreases with donor age because, as the cornea ages or is injured, the endothelial cells die and are not replaced. Therefore, as the population ages, the supply of donor tissue having suitably healthy corneal endothelium decreases. Moreover, the number and quality of donated corneas is expected to decline as the popularity of LASIK surgery increases (these corneas are rejected for transplantation).

Diseases of the cornea may involve one or more of the cornea's five layers: the corneal epithelium, Bowman's layer, the corneal stroma, Descemet's membrane, and the corneal endothelium. The corneal epithelium, corneal stroma, and corneal endothelium are cellular layers, while Bowman's layer and Descemet's membrane are primarily composed of collagen fibrils. The corneal endothelium is a single layer of cells on the inner surface of the cornea. It faces the chamber formed between the cornea and the iris and keeps the cornea transparent by regulating fluid levels. Without functional corneal endothelium, the cornea becomes cloudy and vision is lost. Properly functioning corneal endothelial cells maintain the proper fluid levels in the cornea, e.g., the balance between "leakage" of fluid into the stroma and active pumping that continuously operates to move fluid from the stroma to the anterior chamber of the eye.

Corneal endothelial cells have been reported to have little or no capacity to proliferate in vivo, such that they are not replaced when injured or otherwise lost. In humans, the corneal endothelial cell layer is most densely packed at birth and cell density thereafter decreases rapidly as the eyes grow (reflecting the same number of cells covering a larger area). Thereafter, corneal cell density gradually declines with age, apparently reflecting the gradual loss of cells which are not replaced. As cell density decreases, each cell spreads out and covers a larger area to maintain the cell layer's barrier and pump functions. However, once the cell density drops too low (lower than about 500 to 1000 cells/mm$^2$) its function is compromised, resulting in corneal clouding, stromal edema, loss of visual acuity and eventual blindness. Specifically, the cell density of tightly packed corneal endothelium in vivo has been reported to be as high as 5624 cells/mm$^2$ in infants two months of age, falling to 4252 cells/mm$^2$ within the first year from birth, and subsequently decreasing rapidly during early childhood (associated with the increase in corneal size as eyes grow). By 5 years of age, corneal endothelium density falls to approximately 3591 plus or minus 399 cells/mm$^2$ and falls farther to approximately 2697 plus or minus 246 cells/mm$^2$ by 10 years of age, and further declines by approximately 0.6% per year throughout adulthood. See Peh et al., Transplantation. 2011 Apr. 27; 91(8):811-9.

Primary diseases that affect the corneal endothelium include Fuch's dystrophy, iridocorneal endothelial syndrome, posterior polymorphous dystrophy, and congenital hereditary endothelial dystrophy. Secondary diseases for which the most effective treatment is replacement of the corneal endothelium include several corneal dystrophies, contact lens usage, cataract surgery, and late endothelial failure in cornea transplantation. The preferred treatment when only the corneal endothelium is compromised is Descemet's stripping with endothelial keratoplasty (DSEK), which includes the removal of Descemet's membrane and the corneal endothelium, and subsequent transplantation of donor tissue. Alternatively, in penetrating keratoplasty (PKP) the entire cornea is removed and replaced.

Generally, corneal transplantation includes obtaining a donor cornea (e.g., from a post-mortem anatomical gift), determining whether the donor cornea is of sufficient quality and otherwise suitable for use, and surgical replacement of the damaged or diseased cornea. Procedures have been developed to replace the entire cornea (penetrating keratoplasty) or leave the patient's Descemet's membrane and endothelium and replace the remaining layers with donated tissue (lamellar keratoplasty); the latter procedure may decrease the risk of transplant rejection but may also give inferior visual acuity post-transplant. Additionally, lamellar keratoplasty may not be suitable for treatment of some conditions for which replacement of the patient's corneal endothelium and/or Descemet's membrane may be the indicated treatment. See, generally, U.S. Pat. Nos. 5,755,785, 5,649,944, 7,147,648, 7,300,653, 5,584,881, 5,686,414, 7,300,654, U.S. patent application Ser. No. 10/525,391, each of which is incorporated by reference in its entirety. Additional methods of corneal endothelial surgical replacement are under development, including Descemet's Membrane Endothelial Keratoplasty (DMEK), in which the donor tissue consists only of Descemet's membrane and corneal endothelium. Another potentially promising therapeutic avenue is corneal endothelial reconstruction, in which corneal endothelial cells are cultured in vitro prior to transplantation. For example, donated human corneal cells were cultured on a polymer, released onto a bioadhesive gelatin disc, and then successfully integrated into denuded rabbit corneas, with the gelatin disc dissolving after transplantation (Hsiue et al., Transplantation. 2006 Feb. 15; 81(3):473-6, which is incorporated by reference herein in its entirety). However, methods utilizing culture cells presuppose a source of said cells, and thus are affected by the shortage of suitable donated tissues as described above. Additionally, due to differences among donated cells, it may prove difficult to produce corneal endothelial cell cultures of consistent quality and efficacy. Regulatory hurdles may also make such methods logistically difficult to perform on a large scale, due to the possibility that extensive testing for safety and/or efficacy may be required for the cells obtained from each donor. These and additional therapeutic methods are further described in Thomas John, Corneal Endothelial Transplant: DSAEK, DMEK & DLEK (JP Medical Ltd, 2010), which is incorporated by reference herein in its entirety.

Additional disclosures generally related to methods of obtaining and using corneal cells, including therapeutic methods, culture methods, preservation methods, compositions containing or that that may be used in conjunction therewith, and the like are included in U.S. 2007/0275365, US 2010/0209402, US 2010/0233240, US 2011/0009488, US 2009/0232772, U.S. Pat. No. 5,166,048, US 2007/0092550, US 2005/0214259, US 2007/0148137, U.S. Pat. Nos. 4,959,319, 5,310,728, 5,589,451, US 2010/0215717, U.S. Pat. No. 5,703,047, US 2009/0222086, US 2009/0263465, US 2006/0228693, US 2006/0240552, US 2009/0270982, U.S. Pat. Nos. 5,269,812, 7,371,513, US 2010/0069915, US 2011/0166650, U.S. Pat. No. 9,752,118, US 2018/0072989 and U.S. Pat. No. 9,752,118 each of which is incorporated by reference herein in its entirety.

Accordingly, there is a need in the art for simple and effective methods for producing corneal endothelial cells.

SUMMARY

The present invention meets this need in the art by providing efficient and effective methods for producing corneal endothelial cells (CEC), e.g., mature CEC, by increasing expression of at least one transcription factor selected from the group consisting of Paired-Like Homeodomain transcription Factor 2 (PITX2), Forkhead box C1 (FOXC1), Transcription Factor AP-2 Beta (TFAP2B), LIM Homeobox Transcription Factor 1 Beta (LMX1B) and POU6F2 (Pou Class 6 Homeobox 2) in corneal endothelial progenitors or pluripotent stem cells, e.g. induced pluripotent stem cells or embryonic stem cells. In one aspect, the invention provides novel and effective methods for generating CEC, e.g., mature CEC, by increasing expression of at least one transcription factor selected from the group consisting of PITX2, FOXC1, TFAP2B, LMX1B and POU6F2 in corneal endothelial progenitors or pluripotent stem cells, e.g., induced pluripotent stem cells or embryonic stem cells.

The methods of the invention are both simple, efficient and effective, and result in the production of CEC., e.g., mature CEC that can be used for a variety of applications disclosed herein, for example, treatment of ocular diseases, e.g., diseases of CEC.

The invention provides for a method of generating corneal endothelial cells, the method comprising increasing expression of at least one transcription factor selected from the group consisting of PITX2, FOXC1, TFAP2B, LMX1B, and POU6F2, in corneal endothelial progenitors, thereby generating corneal endothelial cells.

In certain embodiments, PITX2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 1 to SEQ ID NO: 6. In certain embodiments, FOXC1 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NO: 7. In certain embodiments, TFAP2B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NO: 8. In certain embodiments, LMX1B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 9 to SEQ ID NO: 11. In certain embodiments, POU6F2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 12 to SEQ ID NO: 13.

In certain embodiments, PITX2 comprises an amino acid sequence that is at least 80%, at least 85%, at least 90%, at least 91%, at least 92%, at least 93%, at least 94%, at least 95%, at least 96%, at least 97%, at least 98%, at least 99%, or 100% identical to any one of the amino acid sequences set forth in SEQ ID NO: 51 to SEQ ID NO: 53. In certain embodiments, FOXC1 comprises an amino acid sequence that is at least 80%, at least 85%, at least 90%, at least 91%, at least 92%, at least 93%, at least 94%, at least 95%, at least 96%, at least 97%, at least 98%, at least 99%, or 100% identical to the amino acid sequence set forth in SEQ ID NO: 54. In certain embodiments, TFAP2B comprises an amino acid sequence that is at least 80%, at least 85%, at least 90%, at least 91%, at least 92%, at least 93%, at least 94%, at least 95%, at least 96%, at least 97%, at least 98%, at least 99%, or 100% identical to the amino acid sequence set forth in SEQ ID NO:55. In certain embodiments, LMX1B comprises an amino acid sequence that is at least 80%, at least 85%, at least 90%, at least 91%, at least 92%, at least 93%, at least 94%, at least 95%, at least 96%, at least 97%, at least 98%, at least 99%, or 100% identical to any one of the amino acid sequences set forth in SEQ ID NO: 56 to SEQ ID NO: 58. In certain embodiments, POU6F2 comprises an amino acid sequence that is at least 80%, at least 85%, at least 90%, at least 91%, at least 92%, at least 93%, at least 94%, at least 95%, at least 96%, at least 97%, at least 98%, at least 99%, or 100% identical to any one of the amino acid sequences set forth in SEQ ID NO: 59 to SEQ ID NO: 60.

In one embodiment, the corneal endothelial cells are mature corneal endothelial cells.

In another embodiment, the transcription factor is PITX2.

In another embodiment, PITX2 is at least one isoform of PITX2 selected from the group consisting of PITX2, isoform 1; PITX2, isoform 2; PITX2, isoform 3, PITX2, isoform 4, and PITX2, isoform 5.

In another embodiment, the transcription factor is FOXC1.

In another embodiment, the transcription factor is TFAP2B.

In another embodiment, TFAP2B is at least one isoform of TFAP2B selected from the group consisting of TFAP2B, isoform 1 and TFAP2B, isoform 2.

In another embodiment, the transcription factor is LMX1B.

In another embodiment LMX1B is at least one isoform of LMX1B selected from the group consisting of LMX1B, isoform 1, LMX1B, isoform 2, and LMX1B, isoform 3.

In another embodiment, the transcription factor is POU6F2.

In another embodiment, POU6F2 is at least one isoform of POU6F2 selected from the group consisting of POU6F2, isoform 1 and POU6F2, isoform 2.

In another embodiment, the method further comprises increasing expression of one or more transcription factors selected from the group consisting of ERG, ATF4, ATMIN, BHLHE40, CEBPD, CSRNP1, DRAP1, EGR1, ELF2, EMX2, ESRRA, ETS2, FOS, FOSB, FOSL2, GTF3A, HIF1A, JUN, JUNB, JUND, KLF10, KLF9, MBD3, NFE2L1, NME2, NR1D1, NR4A1, PA2G4, POU3F3, RELA, TBX2, TFDP1, TSC22D1, USF2, YBX1, ZNF207, ZNF358, and ZNF395 in the corneal endothelial progenitors.

In another embodiment, the one or more transcription factor is ERG. In another embodiment, the one or more transcription factor is BHLHE40. In another embodiment, the one or more transcription factor is CEBPD. In another embodiment, the one or more transcription factor is CSRNP1. In another embodiment, the one or more transcription factor is EGR1. In another embodiment, the one or more transcription factor is ESRRA. In another embodiment, the one or more transcription factor is ETS2. In another embodiment, the one or more transcription factor is FOS. In another embodiment, the one or more transcription factor is FOSB. In another embodiment, the one or more transcription factor is FOSL2. In another embodiment, the one or more transcription factor is JUN. In another embodiment, the one or more transcription factor is JUNB. In another embodiment, the one or more transcription factor is JUND. In another embodiment, the one or more transcription factor is KLF10. In another embodiment, the one or more transcription factor is KLF9. In another embodiment, the one or more transcription factor is NR1D1. In another embodiment, the one or more transcription factor is NR4A1. In another embodiment, the one or more transcription factor is TSC22D1.

In another embodiment, increasing the expression of the at least one transcription factor in the corneal endothelial progenitors comprises contacting the corneal endothelial progenitors with the at least one transcription factor.

In another embodiment, the corneal endothelial progenitors comprise an expression vector comprising a nucleic acid encoding the at least one transcription factor.

In another embodiment, the corneal endothelial progenitors comprise an expression vector comprising a nucleic acid encoding the at least one transcription factor wherein the expression vector comprises a self-cleaving sequence.

In another embodiment, the corneal endothelial progenitors comprise an expression vector comprising a nucleic acid encoding the at least one transcription factor wherein the expression vector is a viral vector.

In another embodiment, the corneal endothelial progenitors comprise an expression vector comprising a nucleic acid encoding the at least one transcription factor wherein the expression vector is a non-viral vector.

In another embodiment, the corneal endothelial progenitors comprise an expression vector comprising a nucleic acid encoding the at least one transcription factor wherein the expression vector is an inducible expression vector.

In another embodiment, the corneal endothelial progenitors comprise an expression vector comprising a nucleic acid encoding the at least one transcription factor wherein the expression vector comprises a promoter operably linked to a nucleic acid encoding the at least one transcription factor.

In one embodiment, the promoter is an endogenous promoter.

In one embodiment, the promoter is an artificial promoter.

In one embodiment, the promoter is an inducible promoter.

In another embodiment, increasing the expression of the at least one transcription factor in the corneal endothelial progenitors comprises transduction of corneal endothelial progenitors with a viral vector encoding the at least one transcription factor.

In another embodiment, increasing the expression of the at least one transcription factor in the corneal endothelial progenitors comprises transfection of corneal endothelial progenitors with an expression vector encoding the at least one transcription factor.

In another embodiment, the corneal endothelial progenitors are cultured for at least 2, 3, 4, 5, 6, 7, 8, 9, 10, 11 or 12 days before increasing the expression of the at least one transcription factor.

In another embodiment, the corneal endothelial progenitors are cultured for at least 10, 12, 14, 16, 18, 20, 21, 22, 23, 24, 25, 26, 27, 28, 29 or 30 days after increasing the expression of the at least one transcription factor.

In another embodiment, increasing the expression of PITX2 comprises an increase of at least 0.1-fold, 0.2-fold, 0.5-fold, 1-fold, 2-fold, 5-fold, 10-fold, 20-fold, 50-fold, 100-fold, 200-fold, 500-fold, 1,000-fold, or 10,000-fold relative to endogenous expression levels of PITX2 in the corneal endothelial progenitors.

In another embodiment, increasing the expression of FOXC1 comprises an increase of at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of FOXC1 in the corneal endothelial progenitors.

In another embodiment, increasing the expression of TFAP2B comprises an increase of at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of TFAP2B in the corneal endothelial progenitors.

In another embodiment, increasing the expression of LMX1B comprises an increase of at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of LMX1B in the corneal endothelial progenitors.

In another embodiment, increasing the expression of POU6F2 comprises an increase of at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of POU6F2 in the corneal endothelial progenitors.

In another embodiment, the corneal endothelial cells exhibit an increased expression of one or more markers selected from the group consisting of: PITX2, SLC4A11, FOXC1, COL8A1, COL8A2, TFAP2B, LMX1B and MRGPRX3 relative to corneal endothelial progenitors.

In another embodiment, the corneal endothelial cells exhibit an increased expression of one or more markers selected from the group consisting of: PITX2, SLC4A11, FOXC1, COL8A1, COL8A2, TFAP2B AND LMX1B relative to corneal endothelial progenitors.

In another embodiment, the corneal endothelial cells exhibit an increased expression of one or more markers selected from the group consisting of: COL8A1, COL8A2, SLC4A11 and MRGPRX3 relative to corneal endothelial progenitors.

In another embodiment, the increased expression of the one or more markers comprises an increase of at least 2-fold, 5-fold, 10-fold, 50-fold, 100-fold, 200-fold, 500-fold, 1,000-fold, 2,000-fold, 5,000-fold, or 10,000-fold relative to corneal endothelial progenitors.

In another embodiment, the corneal endothelial cell exhibits a decreased expression of NGFR, SOX10, HNK1, SSEA4, NANOG, OCT4, vWF and/or CD31 relative to corneal endothelial progenitors.

In another embodiment, the decreased expression of NGFR, SOX10, HNK1, SSEA4, NANOG, OCT4, vWF and/or CD31 comprises a decrease of at least 0.1-fold, 0.2-fold, 0.5-fold, 1-fold, 2-fold, 3-fold, or 4-fold relative to corneal endothelial progenitors.

In another embodiment, the corneal endothelial cells exhibit one or more of increased pump function, enhanced formation of tight junctions, increased resistance to oxidative stress, and an increase in polygonal morphology, relative to corneal endothelial progenitors.

In another embodiment, the increased pump function, enhanced formation of tight junctions, increased resistance to oxidative stress and an increase in polygonal morphology comprises an increase of at least 5%, 10%, 15%, 20% or 25% relative to corneal endothelial progenitors.

In another embodiment, increasing the expression of the at least one transcription factor shifts the transcriptome of corneal endothelial progenitors towards the transcriptome of corneal endothelial cells by at least 1%, 5%, 10%, 20%, 30%, 40%, or 50%.

In another embodiment, following administration of corneal endothelial cells to the cornea of a subject in need thereof, the cornea exhibits one or more of increased pump activity, increased formation of tight junction, increased resistance to oxidative stress, increased clarity and decreased thickness.

In another embodiment, the corneal endothelial progenitors are derived from pluripotent stem cells.

In another embodiment, the corneal endothelial progenitors are derived from pluripotent stem cells that are embryonic stem cells or induced pluripotent stem cells.

In another embodiment, inducing the expression of the at least one transcription factor in the corneal endothelial progenitors comprises use of a gene switch construct encoding the at least one transcription factor.

In another embodiment, inducing the expression of the at least one transcription factor in the corneal endothelial progenitors comprises use of a gene switch construct encoding the at least one transcription factor, wherein the gene switch construct is a transcriptional gene switch construct.

In another embodiment, inducing the expression of the at least one transcription factor in the corneal endothelial progenitors comprises use of a gene switch construct encoding the at least one transcription factor, wherein the gene switch construct is a post-transcriptional gene switch construct.

The invention also provides for a method of generating pluripotent stem cell derived corneal endothelial cells, the method comprising: (a) culturing pluripotent stem cells and inducing formation of corneal endothelial progenitors or neural crest stem cells, wherein the pluripotent stem cells comprise an expression vector comprising a nucleic acid encoding at least one transcription factor selected from the group consisting of PITX2, FOXC1, TFAP2B, LMX1B, and POU6F2, and (b) increasing expression of the at least one transcription factor from the expression vector in the corneal endothelial progenitors or the neural crest stem cells, thereby generating corneal endothelial cells.

In certain embodiments, PITX2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 1 to SEQ ID NO: 6. In certain embodiments, FOXC1 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NO: 7. In certain embodiments, TFAP2B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NO: 8. In certain embodiments, LMX1B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 9 to SEQ ID NO: 11. In certain embodiments, POU6F2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 12 to SEQ ID NO: 13.

In certain embodiments, PITX2 comprises an amino acid sequence that is at least 80%, at least 85%, at least 90%, at least 91%, at least 92%, at least 93%, at least 94%, at least 95%, at least 96%, at least 97%, at least 98%, at least 99%, or 100% identical to any one of the amino acid sequences set forth in SEQ ID NO: 51 to SEQ ID NO: 53. In certain embodiments, FOXC1 comprises an amino acid sequence that is at least 80%, at least 85%, at least 90%, at least 91%, at least 92%, at least 93%, at least 94%, at least 95%, at least 96%, at least 97%, at least 98%, at least 99%, or 100% identical to the amino acid sequence set forth in SEQ ID NO: 54. In certain embodiments, TFAP2B comprises an amino acid sequence that is at least 80%, at least 85%, at least 90%, at least 91%, at least 92%, at least 93%, at least 94%, at least 95%, at least 96%, at least 97%, at least 98%, at least 99%, or 100% identical to the amino acid sequence set forth in SEQ ID NO:55. In certain embodiments, LMX1B comprises an amino acid sequence that is at least 80%, at least 85%, at least 90%, at least 91%, at least 92%, at least 93%, at least 94%, at least 95%, at least 96%, at least 97%, at least 98%, at least 99%, or 100% identical to any one of the amino acid sequences set forth in SEQ ID NO: 56 to SEQ ID NO: 58. In certain embodiments, POU6F2 comprises an amino acid sequence that is at least 80%, at least 85%, at least 90%, at least 91%, at least 92%, at least 93%, at least 94%, at least 95%, at least 96%, at least 97%, at least 98%, at least 99%, or 100% identical to any one of the amino acid sequences set forth in SEQ ID NO: 59 to SEQ ID NO: 60.

In one embodiment, the corneal endothelial cells are mature corneal endothelial cells.

In another embodiment, the pluripotent stem cells are embryonic stem cells.

In another embodiment, the pluripotent stem cells are induced pluripotent stem cells.

In another embodiment, the transcription factor is PITX2.

In another embodiment, PITX2 is at least one isoform of PITX2 selected from the group consisting of PITX2, isoform 1; PITX2, isoform 2; PITX2, isoform 3, PITX2, isoform 4, and PITX2, isoform 5.

In another embodiment, the transcription factor is FOXC1.

In another embodiment, the transcription factor is TFAP2B.

In another embodiment, TFAP2B is at least one isoform of TFAP2B selected from the group consisting of TFAP2B, isoform 1 and TFAP2B, isoform 2.

In another embodiment, the transcription factor is LMX1B.

In another embodiment, LMX1B is at least one isoform of LMX1B selected from the group consisting of LMX1B, isoform 1, LMX1B, isoform 2, and LMX1B, isoform 3.

In another embodiment, the transcription factor is POU6F2.

In another embodiment, POU6F2 is at least one isoform of POU6F2 selected from the group consisting of POU6F2, isoform 1 and POU6F2, isoform 2.

In another embodiment, the method further comprises increasing expression of one or more transcription factors selected from the group consisting of ERG, ATF4, ATMIN, BHLHE40, CEBPD, CSRNP1, DRAP1, EGR1, ELF2, EMX2, ESRRA, ETS2, FOS, FOSB, FOSL2, GTF3A, HIF1A, JUN, JUNB, JUND, KLF10, KLF9, MBD3, NFE2L1, NME2, NR1D1, NR4A1, PA2G4, POU3F3, RELA, TBX2, TFDP1, TSC22D1, USF2, YBX1, ZNF207, ZNF358, and ZNF395.

In another embodiment, the one or more transcription factor is ERG. In another embodiment, the one or more transcription factor is BHLHE40. In another embodiment, the one or more transcription factor is CEBPD. In another embodiment, the one or more transcription factor is CSRNP1. In another embodiment, the one or more transcription factor is EGR1. In another embodiment, the one or more transcription factor is ESRRA. In another embodiment, the one or more transcription factor is ETS2. In another embodiment, the one or more transcription factor is FOS. In another embodiment, the one or more transcription factor is FOSB. In another embodiment, the one or more transcription factor is FOSL2. In another embodiment, the one or more transcription factor is JUN. In another embodiment, the one or more transcription factor is JUNB. In another embodiment, the one or more transcription factor is JUND. In another embodiment, the one or more transcription factor is KLF10. In another embodiment, the one or more transcription factor is KLF9. In another embodiment, the one or more transcription factor is NR1D1. In another embodiment, the one or more transcription factor is NR4A1. In another embodiment, the one or more transcription factor is TSC22D1.

In another embodiment, the expression vector is a viral vector.

In another embodiment, the expression vector is a non-viral vector.

In another embodiment, the expression vector is an inducible expression vector.

In another embodiment, the expression vector comprises a promoter operably linked to a nucleic acid encoding the at least one transcription factor.

In another embodiment, the expression vector comprises a promoter operably linked to a nucleic acid encoding the at least one transcription factor wherein the promoter is an endogenous promoter.

In another embodiment, the expression vector comprises a promoter operably linked to a nucleic acid encoding the at least one transcription factor, wherein the promoter is an artificial promoter.

In another embodiment, the expression vector comprises a promoter operably linked to a nucleic acid encoding the at least one transcription factor, wherein the promoter is an inducible promoter.

In another embodiment, increasing the expression of the at least one transcription factor in the corneal endothelial progenitors comprises inducing expression of the at least one transcription factor in the corneal endothelial progenitors or neural crest stem cells.

In another embodiment, inducing the expression of the at least one transcription factor in the corneal endothelial progenitors or neural crest stem cells comprises use of a gene switch construct encoding the at least one transcription factor.

In another embodiment, inducing the expression of the at least one transcription factor in the corneal endothelial progenitors or neural crest stem cells comprises use of a gene switch construct encoding the at least one transcription factor, wherein the gene switch construct is a transcriptional gene switch construct.

In another embodiment, inducing the expression of the at least one transcription factor in the corneal endothelial progenitors or neural crest stem cells comprises use of a gene switch construct encoding the at least one transcription factor, wherein the gene switch construct is a post-transcriptional gene switch construct.

In another embodiment, the pluripotent stem cells are transduced with a viral vector encoding the at least one transcription factor.

In another embodiment, the pluripotent stem cells are transfected with an expression vector encoding the at least one transcription factor.

In another embodiment, step (a) comprises culturing the pluripotent stem cells with at least one inhibitor of Small/Mothers Against Decapentaplegic (SMAD) protein signaling to induce differentiation of the pluripotent stem cells into corneal endothelial progenitors or into neural crest stem cells.

In another embodiment, the corneal endothelial progenitors or neural crest stem cells are cultured for at least 2, 3, 4, 5, 6, 7, 8, 9, 10, 11 or 12 days before increasing the expression of the at least one transcription factor.

In another embodiment, the corneal endothelial progenitors or neural crest stem cells are cultured for at least 8, 10, 12, 14, 16, 18, 20, 21, 22, 23, 24, 25, 26, 27, 28, 29 or 30 days after increasing the expression of the at least one transcription factor.

In another embodiment, increasing the expression of PITX2 comprises an increase of at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of PITX2 in the corneal endothelial progenitors or neural crest stem cells.

In another embodiment, increasing the expression of FOXC1 comprises an increase of at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of FOXC1 in the corneal endothelial progenitors or neural crest stem cells.

In another embodiment, increasing the expression of TFAP2B comprises an increase of at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of TFAP2B in the corneal endothelial progenitors or neural crest stem cells.

In another embodiment, increasing the expression of LMX1B comprises an increase of at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of LMX1B in the corneal endothelial progenitors or neural crest stem cells.

In another embodiment, increasing the expression of POU6F2 comprises an increase of at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of POU6F2 in the corneal endothelial progenitors or neural crest stem cells.

In another embodiment, the corneal endothelial cells exhibit an increased expression of one or more markers selected from the group consisting of: PITX2, SLC4A11, FOXC1, COL8A1, COL8A2, TFAP2B, LMX1B and MRGPRX3 relative to corneal endothelial progenitors or neural crest stem cells.

In another embodiment, the corneal endothelial cells exhibit an increased expression of one or more markers selected from the group consisting of: PITX2, SLC4A11, FOXC1, COL8A1, COL8A2, TFAP2B and LMX1B relative to corneal endothelial progenitors or neural crest stem cells.

In another embodiment, the corneal endothelial cells exhibit an increased expression of one or more markers selected from the group consisting of: COL8A1, COL8A2, SLC4A11 and MRGPRX3 relative to corneal endothelial progenitors or neural crest stem cells.

In another embodiment, the increased expression of the one or more of markers comprises an increase of at least 2-fold, 5-fold, 10-fold, 50-fold, 100-fold, 200-fold, 500-fold, 1,000-fold, 2,000-fold, 5,000-fold, or 10,000-fold relative to corneal endothelial progenitors.

In another embodiment, the corneal endothelial cell exhibits a decreased expression of NGFR, SOX10, HNK1, SSEA4, NANOG, OCT4, vWF and/or CD31 relative to corneal endothelial progenitors or neural crest stem cells.

In another embodiment, the decreased expression of NGFR, SOX10, HNK1, SSEA4, NANOG, OCT4, vWF and/or CD31 comprises a decrease of at least 0.1-fold, 0.2-fold, 0.5-fold, 1-fold, 2-fold, 3-fold, or 4-fold relative to corneal endothelial progenitors or neural crest stem cells.

In another embodiment, the corneal endothelial cells exhibit one or more of an increased pump function, enhanced formation of tight junctions, increased resistance to oxidative stress, and an increase in polygonal morphology, relative to corneal endothelial progenitors.

In another embodiment the increased pump function, enhanced formation of tight junctions, increased resistance to oxidative stress, and an increase in polygonal morphology comprises an increase of at least 5%, 10%, 15%, 20% or 25% relative to corneal endothelial progenitors.

In another embodiment, following administration of corneal endothelial cells to the cornea of a subject in need thereof, the cornea exhibits one or more of increased pump activity, increased formation of tight junction, increased resistance to oxidative stress, increased clarity and decreased thickness.

In another embodiment, increasing the expression of the at least one transcription factor shifts the transcriptome of corneal endothelial progenitors towards the transcriptome of corneal endothelial cells by at least 1%, 5%, 10%, 20%, 30%, 40%, or 50%.

In another embodiment, increasing the expression of the at least one transcription factor shifts the transcriptome of neural crest stem cells towards the transcriptome of corneal endothelial cells by at least 1%, 5%, 10%, 20%, 30%, 40%, or 50%.

The invention also provides a population of corneal endothelial cells produced by the methods of the invention.

The invention also provides a population of corneal endothelial cells produced by a method comprising increasing expression of at least one transcription factor selected from the group consisting of PITX2, FOXC1, TFAP2B, LMX1B and POU6F2, in corneal endothelial progenitors, thereby generating corneal endothelial cells.

The invention also provides a population of corneal endothelial cells produced by a method comprising: (a) culturing pluripotent stem cells and inducing formation of corneal endothelial progenitors, wherein the pluripotent stem cells comprise an expression vector comprising a nucleic acid encoding at least one transcription factor selected from the group consisting of PITX2, FOXC1, TFAP2B, LMX1B and POU6F2, and (b) increasing expression of the at least one transcription factor from the expression vector in the corneal endothelial progenitors, thereby generating corneal endothelial cells.

In certain embodiments, PITX2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 1 to SEQ ID NO: 6. In certain embodiments, FOXC1 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NO: 7. In certain embodiments, TFAP2B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NO: 8. In certain embodiments, LMX1B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 9 to SEQ ID NO: 11. In certain embodiments, POU6F2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 12 to SEQ ID NO: 13.

In certain embodiments, PITX2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to any one of the amino acid sequences set forth in SEQ ID NO: 51 to SEQ ID NO: 53. In certain embodiments, FOXC1 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence set forth in SEQ ID NO: 54. In certain embodiments, TFAP2B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence set forth in SEQ ID NO:55. In certain embodiments, LMX1B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to any one of the amino acid sequences set forth in SEQ ID NO: 56 to SEQ ID NO: 58. In certain embodiments, POU6F2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to any one of the amino acid sequences set forth in SEQ ID NO: 59 to SEQ ID NO: 60.

The invention also provides for a pharmaceutical composition comprising a population of corneal endothelial cells produced by the methods of the invention, and a pharmaceutically acceptable carrier.

The invention also provides for a pharmaceutical composition comprising a population of corneal endothelial cells produced by a method comprising increasing expression of at least one transcription factor selected from the group consisting of PITX2, FOXC1, TFAP2B, LMX1B and POU6F2, in corneal endothelial progenitors, thereby generating corneal endothelial cells and a pharmaceutically acceptable carrier.

The invention also provides for a pharmaceutical composition comprising a population of corneal endothelial cells produced by a method comprising: (a) culturing pluripotent stem cells and inducing formation of corneal endothelial progenitors, wherein the pluripotent stem cells comprise an expression vector comprising a nucleic acid encoding at least one transcription factor selected from the group consisting of PITX2, FOXC1, TFAP2B, LMX1B, and POU6F2, and (b) increasing expression of the at least one transcription factor from the expression vector in the corneal endothelial progenitors, thereby generating corneal endothelial cells and a pharmaceutically acceptable carrier.

In certain embodiments, PITX2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 1 to SEQ ID NO: 6. In certain embodiments, FOXC1 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NO: 7. In certain embodiments, TFAP2B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NO: 8. In certain embodiments, LMX1B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 9 to SEQ ID NO: 11. In certain embodiments, POU6F2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 12 to SEQ ID NO: 13.

In certain embodiments, PITX2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to any one of the amino acid sequences set forth in SEQ ID NO: 51 to SEQ ID NO: 53. In certain embodiments, FOXC1 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence set forth in SEQ ID NO: 54. In certain embodiments, TFAP2B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence set forth in SEQ ID NO:55. In certain embodiments, LMX1B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to any one of the amino acid sequences set forth in SEQ ID NO: 56 to SEQ ID NO: 58. In certain embodiments, POU6F2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to any one of the amino acid sequences set forth in SEQ ID NO: 59 to SEQ ID NO: 60.

The invention also provides for a population of corneal endothelial cells comprising increased expression levels of at least one transcription factor selected from the group consisting of PITX2, FOXC1, TFAP2B, LMX1B, and POU6F2 relative to endogenous expression levels of the transcription factor in the population of corneal endothelial cells.

In one embodiment, the corneal endothelial cells are mature corneal endothelial cells.

In another embodiment, the corneal endothelial cells exhibit an increased expression of one or more markers selected from the group consisting of: PITX2, SLC4A11, FOXC1, COL8A1, COL8A2, TFAP2B, LMX1B and MRGPRX3 relative to corneal endothelial progenitors.

In certain embodiments, PITX2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 1 to SEQ ID NO: 6. In certain embodiments, FOXC1 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NO: 7. In certain embodiments, TFAP2B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NO: 8. In certain embodiments, LMX1B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 9 to SEQ ID NO: 11. In certain embodiments, POU6F2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 12 to SEQ ID NO: 13.

In certain embodiments, PITX2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to any one of the amino acid sequences set forth in SEQ ID NO: 51 to SEQ ID NO: 53. In certain embodiments, FOXC1 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence set forth in SEQ ID NO: 54. In certain embodiments, TFAP2B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence set forth in SEQ ID NO:55. In certain embodiments, LMX1B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to any one of the amino acid sequences set forth in SEQ ID NO: 56 to SEQ ID NO: 58. In certain embodiments, POU6F2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to any one of the amino acid sequence set forth in SEQ ID NO: 59 to SEQ ID NO: 60.

In another embodiment, the corneal endothelial cells of the population of corneal endothelial cells exhibit an increased expression of one or more markers selected from the group consisting of: PITX2, SLC4A11, FOXC1, COL8A1, COL8A2, TFAP2B and LMX1B relative to corneal endothelial progenitors.

In another embodiment, the corneal endothelial cells of the population of corneal endothelial cells exhibit an increased expression of one or more markers selected from the group consisting of: COL8A1, COL8A2, SLC4A11 and MRGPRX3 relative to corneal endothelial progenitors.

In another embodiment, the increased expression comprises exogenous expression of the at least one transcription factor.

In another embodiment, the corneal endothelial cells comprise an expression vector comprising a nucleic acid encoding the at least one transcription factor.

In another embodiment the corneal endothelial progenitors comprise an expression vector comprising a nucleic acid encoding the at least one transcription factor wherein the expression vector comprises a self-cleaving sequence.

In another embodiment, the corneal endothelial cells comprise an expression vector comprising a nucleic acid encoding the at least one transcription factor, wherein the expression vector is a viral vector.

In one embodiment, the viral vector is selected from the group consisting of an adeno-associated virus (AAV) vector, an adenovirus vector, a lentivirus vector, a herpes simplex virus vector, a sendai virus vector, and a retrovirus vector.

In another embodiment, the corneal endothelial cells comprise an expression vector comprising a nucleic acid encoding the at least one transcription factor, wherein the expression vector is a non-viral vector.

In one embodiment, the non-viral vector is selected from the group consisting of a plasmid DNA, a linear double-stranded DNA (dsDNA), a linear single-stranded DNA (ssDNA), a nanoplasmid, a minicircle DNA, a single-stranded oligodeoxynucleotide (ssODN), a DDNA oligonucleotide, a single-stranded mRNA (ssRNA), and a double-stranded mRNA (dsRNA).

In another embodiment, the non-viral vector comprises a naked nucleic acid, a liposome, a dendrimer, a nanoparticle, a lipid-polymer system, a solid lipid nanoparticle, and/or a liposome protamine/DNA lipoplex (LPD).

In another embodiment, the corneal endothelial cells comprise an expression vector comprising a nucleic acid encoding the at least one transcription factor, wherein the expression vector is an inducible expression vector.

In another embodiment, the corneal endothelial cells comprise an expression vector comprising a nucleic acid encoding the at least one transcription factor, wherein the expression vector comprises a promoter operably linked to a nucleic acid encoding the at least one transcription factor.

In another embodiment, the promoter is an endogenous promoter.

In another embodiment, the promoter is an artificial promoter.

In another embodiment, the promoter is an inducible promoter.

In one embodiment, the transcription factor is PITX2.

In another embodiment, the increased expression of PITX2 comprises an increase of at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of PITX2 in the population of corneal endothelial cells.

In another embodiment, the transcription factor is FOXC1.

In another embodiment the increased expression of FOXC1, comprises an increase of at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of FOXC1 in the population of corneal endothelial cells.

In another embodiment, the transcription factor is TFAP2B.

In another embodiment, the increased expression of TFAP2B comprises an increase of at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of TFAP2B in the population of corneal endothelial cells.

In another embodiment, the transcription factor is LMX1B.

In another embodiment, the increased expression of LMX1B comprises an increase of at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of LMX1B in the population of corneal endothelial cells.

In another embodiment, the transcription factor is POU6F2.

In another embodiment, the increased expression of POU6F2 comprises an increase of at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of PITX2 in the population of corneal endothelial cells.

In another embodiment, the population of corneal endothelial cells is a population of mature corneal endothelial cells.

In another embodiment, the corneal endothelial cells are derived from pluripotent stem cells.

In another embodiment, the pluripotent stem cells are embryonic stem cells or induced pluripotent stem cells.

In another embodiment, the population of corneal endothelial cells comprises at least $10^6$ corneal endothelial cells.

The invention also provides for a pluripotent stem cell comprising an expression vector comprising a nucleic acid encoding at least one transcription factor selected from the group consisting of PITX2, FOXC1, TFAP2B, LMX1B and POU6F2.

In certain embodiments, PITX2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 1 to SEQ ID NO: 6. In certain embodiments, FOXC1 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NO: 7. In certain embodiments, TFAP2B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NO: 8. In certain embodiments, LMX1B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 9 to SEQ ID NO: 11. In certain embodiments, POU6F2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 12 to SEQ ID NO: 13.

In certain embodiments, PITX2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to any one of the amino acid sequences set forth in SEQ ID NO: 51 to SEQ ID NO: 53. In certain embodiments, FOXC1 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence set forth in SEQ ID NO: 54. In certain embodiments, TFAP2B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence set forth in SEQ ID NO:55. In certain embodiments, LMX1B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to any one of the amino acid sequences set forth in SEQ ID NO: 56 to SEQ ID NO: 58. In certain embodiments, POU6F2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to any one of the amino acid sequences set forth in SEQ ID NO: 59 to SEQ ID NO: 60.

In one embodiment, the expression vector is a viral vector.

In another embodiment, the expression vector is a non-viral vector.

In another embodiment, the expression vector is an inducible expression vector.

In another embodiment, the expression vector comprises a promoter operably linked to a nucleic acid encoding the at least one transcription factor.

In another embodiment, the promoter is an endogenous promoter.

In another embodiment, the promoter is an artificial promoter.

In another embodiment, the promoter is an inducible promoter.

In another embodiment, the pluripotent stem cells comprise a gene switch construct encoding the at least one transcription factor.

In another embodiment, the gene switch construct is a transcriptional gene switch construct.

In another embodiment, the gene switch construct is a post-transcriptional gene switch construct.

The invention also provides for a corneal endothelial cell comprising an expression vector comprising a nucleic acid encoding at least one transcription factor selected from the group consisting of PITX2, FOXC1, TFAP2B, LMX1B and POU6F2.

In certain embodiments, PITX2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 1 to SEQ ID NO: 6. In certain embodiments, FOXC1 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NO: 7. In certain embodiments, TFAP2B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NO: 8. In certain embodiments, LMX1B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 9 to SEQ ID NO: 11. In certain embodiments, POU6F2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 12 to SEQ ID NO: 13.

In certain embodiments, PITX2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to any one of the amino acid sequences set forth in SEQ ID NO: 51 to SEQ ID NO: 53. In certain embodiments, FOXC1 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence set forth in SEQ ID NO: 54. In certain embodiments, TFAP2B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence set forth in SEQ ID NO:55. In certain embodiments, LMX1B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to any one of the amino acid sequences set forth in SEQ ID NO: 56 to SEQ ID NO: 58. In certain embodiments, POU6F2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to any one of the amino acid sequence set forth in SEQ ID NO: 59 to SEQ ID NO: 60.

In one embodiment, the corneal endothelial cell is a mature corneal endothelial cell.

In another embodiment, the expression vector is a viral vector.

In another embodiment, the expression vector is a non-viral vector.

In another embodiment, the expression vector is an inducible expression vector.

In another embodiment, the expression vector comprises a promoter operably linked to a nucleic acid encoding the at least one transcription factor.

In another embodiment the promoter is an endogenous promoter.

In another embodiment, the expression vector comprises a promoter operably linked to a nucleic acid encoding the at least one transcription factor wherein the promoter is an artificial promoter.

In another embodiment, the expression vector comprises a promoter operably linked to a nucleic acid encoding the at least one transcription factor wherein the promoter is an inducible promoter.

In another embodiment, the pluripotent stem cells comprise a gene switch construct encoding the at least one transcription factor.

In another embodiment, the pluripotent stem cells comprise a gene switch construct encoding the at least one transcription factor wherein the gene switch construct is a transcriptional gene switch construct.

In another embodiment, the pluripotent stem cells comprise a gene switch construct encoding the at least one transcription factor wherein the gene switch construct is a post-transcriptional gene switch construct.

The invention also provides for a pharmaceutical composition comprising a population of corneal endothelial cells, a composition of corneal endothelial cells or corneal endothelial cells of the invention.

The invention also provides for a pharmaceutical composition comprising a population of corneal endothelial cells, a composition of corneal endothelial cells or corneal endothelial cells prepared by a method of the invention.

The invention also provides for a method of treating a disease in a subject in need thereof, the method comprising administering to the subject an effective amount of a population of corneal endothelial cells, a composition comprising corneal endothelial cells, corneal endothelial cells or a pharmaceutical composition comprising a population of corneal endothelial cells, a composition comprising corneal endothelial cells, or corneal endothelial cells, each according to the invention, thereby treating the disease in the subject.

The invention also provides for a method of treating a disease in a subject in need thereof, the method comprising administering to the subject an effective amount of a population of corneal endothelial cells, a composition comprising corneal endothelial cells, corneal endothelial cells or a pharmaceutical composition comprising a population of corneal endothelial cells, a composition comprising corneal endothelial cells, or corneal endothelial cells, each prepared by a method of the invention, thereby treating the disease in the subject wherein the corneal.

In one embodiment, the disease is selected from the group consisting of: Fuch's dystrophy, iridocorneal endothelial syndrome, posterior polymorphous dystrophy, congenital hereditary endothelial dystrophy, corneal dystrophies, and late endothelial failure in cornea transplantation.

The invention also provides for a method of treating a subject in need thereof, wherein the subject exhibits symptoms of corneal edema leading to Bullous Keratopathy, wherein the subject has ocular damage due to contact lens usage or cataract surgery or wherein the subject has sustained surgical trauma, the method comprising administering to the subject population of corneal endothelial cells, a composition comprising corneal endothelial cells, corneal endothelial cells or a pharmaceutical composition comprising a population of corneal endothelial cells, a composition comprising corneal endothelial cells, or corneal endothelial cells, each according to the invention, thereby treating the subject.

The invention also provides for a method of treating a subject in need thereof, wherein the subject exhibits symptoms of corneal edema leading to Bullous Keratopathy, wherein the subject has ocular damage due to contact lens usage or cataract surgery or wherein the subject has sustained surgical trauma, the method comprising administering to the subject an effective amount of a population of corneal endothelial cells, a composition comprising corneal endothelial cells, corneal endothelial cells or a pharmaceutical composition comprising a population of corneal endothelial cells, a composition comprising corneal endothelial cells, or corneal endothelial cells, each prepared by a method of the invention, thereby treating the subject.

The invention also provides for a kit comprising a composition comprising a population of corneal endothelial cells, a composition comprising corneal endothelial cells, corneal endothelial cells or a pharmaceutical composition comprising a population of corneal endothelial cells, a composition comprising corneal endothelial cells, or corneal endothelial cells, each according to the invention.

The invention also provides for a kit comprising a composition comprising a population of corneal endothelial cells, a composition comprising corneal endothelial cells, corneal endothelial cells or a pharmaceutical composition comprising a population of corneal endothelial cells, a composition comprising corneal endothelial cells, or corneal endothelial cells, each prepared according to a method of the invention.

In one embodiment, the kit comprises an expression vector comprising a nucleic acid encoding at least one transcription factor selected from the group consisting of PITX2, FOXC1, TFAP2B, LMX1B and POU6F2.

In certain embodiments, PITX2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 1 to SEQ ID NO: 6. In certain embodiments, FOXC1 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NO: 7. In certain embodiments, TFAP2B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NO: 8. In certain embodiments, LMX1B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 9 to SEQ ID NO: 11. In certain embodiments, POU6F2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by any one of the nucleotide sequences of SEQ ID NO: 12 to SEQ ID NO: 13.

In certain embodiments, PITX2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to any one of the amino acid sequences set forth in SEQ ID NO: 51 to SEQ ID NO: 53. In certain embodiments, FOXC1 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence set forth in SEQ ID NO: 54. In certain embodiments, TFAP2B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence set forth in SEQ ID NO:55. In certain embodiments, LMX1B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to any one of the amino acid sequences set forth in SEQ ID NO: 56 to SEQ ID NO: 58. In certain embodiments, POU6F2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to any one of the amino acid sequences set forth in SEQ ID NO: 59 to SEQ ID NO: 60.

The invention also provides for a kit comprising at least one transcription factor selected from the group consisting of PITX2, FOXC1, TFAP2B, LMX1B and POU6F2.

The present invention is further illustrated by the following detailed description and figures.

BRIEF DESCRIPTION OF THE DRAWINGS

FIG. 5 is a table presenting transcription factor isoforms enriched in human corneal endothelial cells.

DETAILED DESCRIPTION

Figure 1:
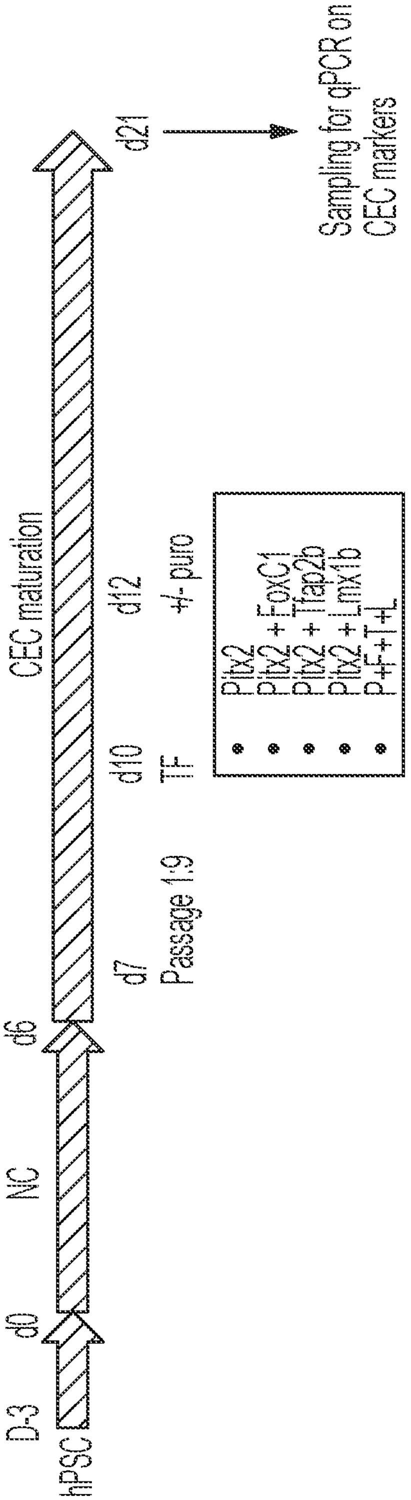
FIG. 1 is a schematic illustration of a method of generating CEC, e.g., mature CEC from pluripotent stem cells. Neural crest differentiation was induced from hPSC for 6 days. After 6 days the medium was switched to a medium that supports maturation. Lentiviral infection was performed at day 10, and samples from day 14 and day 21 (or from samples at about d14 to about d28) were assayed by qPCR for expression of the transcription factors expressed by the introduced lentivirus.

The present invention provides efficient and effective methods of generating CEC, e.g., mature CEC. The methods include increasing expression of at least one transcription factor selected from the group consisting of PITX2, FOXC1, TFAP2B, LMX1B AND POU6F2, in corneal endothelial progenitors or pluripotent stem cells, e.g., induced pluripotent stem cells or embryonic stem cells, thereby generating CEC, e.g., mature CEC. Compositions generated by these methods are also provided by the present invention as are methods of using these compositions. CEC, e.g., mature CEC are generated through directed differentiation of pluripotent or multipotent stem cells, including human induced pluripotent stem cells (hiPSC), human embryonic stem cells (hESC) and somatic cells (including transdifferentiated cells and stem cells such as neural crest stem cells). The methods of the invention are efficient and effective, and result in the production of CEC, e.g., mature CEC that can be used for a variety of applications disclosed herein, for example, treatment of ocular diseases, e.g., diseases of the cornea. It is expected that these cells can provide an alternative to the burdensome collection of donated corneas for therapeutic use.

The following detailed description discloses how to make and use the present invention.

In order that the present invention may be more readily understood, certain terms are first defined. It should also be noted that whenever a value or range of values of a parameter are recited, it is intended that values and ranges intermediate to the recited values are also part of this invention.

In the following description, for purposes of explanation, specific numbers, materials, and configurations are set forth in order to provide a thorough understanding of the invention. It will be apparent, however, to one having ordinary skill in the art that the invention may be practiced without these specific details. In some instances, well-known features may be omitted or simplified so as not to obscure the present invention. Furthermore, reference in the specification to phrases such as "one embodiment" or "an embodiment" mean that a particular feature, structure, or characteristic described in connection with the embodiment is included in at least one embodiment of the invention. The appearances of phrases such as "in one embodiment" in various places in the specification are not necessarily all referring to the same embodiment.

Definitions

Unless otherwise specified, each of the following terms have the meaning set forth in this section.

The indefinite articles "a" and "an" refer to at least one of the associated noun, and are used interchangeably with the terms "at least one" and "one or more."

The conjunctions "or" and "and/or" are used interchangeably as non-exclusive disjunctions.

According to the present application, the term "about" means+/−5% of the reference value.

"Corneal endothelial cells" or "CEC" refers generally to the mitochondria-rich cells that (in a living organism) line the posterior surface of the cornea and faces the anterior chamber of the eye. CEC may also be produced from another cell type, e.g., by differentiation of neural crest stem cells, embryonic stem cells (ESC) or induced pluripotent stem cells (iPSC), using the methods described herein. CEC differentiated from NCSCs, ES cells or iPS cells may be identified or recognized by their exhibition of one or more of the attributes of endogenous CEC, such as expression of CEC markers, ability to form a monolayer of uniformly sized cells with a predominantly hexagonal shape, ability to form a "leaky pump" which allows leakage of solutes and nutrients from the aqueous humor to the more superficial layers of the cornea while at the same time actively pumping water in the opposite direction, from the stroma to the aqueous. Exemplary CEC markers include but are not limited to: Na+/K+ ATPase, ZO-1, KLF13, AQP1, Collagen VIII, SLC16A3, CFTR, NBC1, CA2, AE2 SCL4A2, SCL16A1, CA12, CA4, FOXC1. For example, CEC typically express Collagen VIII, Na+K+ ATPase pump, and ZO-1, and do not express vWF and CD31 (the latter being present in vascular endothelial cells). In addition CEC may express one or more corneal endothelial pump markers (which include: Na+/K+ ATPase, SLC4A4, SLC4A11, AQP1, CA2, CA4, CA12, SCL14A2, SLC16A1, SLC16A3, SLC16A7, CFTR, NHE1, ADCY10, voltage-dependent anion channels VDAC2 and VDAC3, chloride channel proteins CLCN2 and CLC), periocular neural crest markers (which include: PITX2, and FOXC1), and/or cell adhesion and matrix proteins (which include: Occludin, Connexin 43, 9.3E antigen, Collagen III, Collagen IV, N cadherin, VE cadherin, E cadherin, beta catenin, p120, p190 Laminin alpha 4, Nidogen-2, and Netrin 4). For example, CEC may express at least one corneal endothelial pump marker, at least one periocular neural crest marker, and at least one cell adhesion and matrix protein. Corneal endothelial cells include mature corneal endothelial cells as defined herein.

In yet another embodiment, CEC display a global gene expression profile that is indicative of CEC maturation. Global gene expression profiles are obtained by any method known in the art, for example transcriptomic analysis or microarray analysis.

The term "mature corneal endothelial cells" or "mature CEC" as used herein refers to a CEC that exhibits markers associated with a mature phenotype including one or more of COL8A1, COL8A2, SLC4A11 and MRGPRX3. Mature CEC form a monolayer of uniformly sized cells with a predominantly hexagonal or polygonal morphology wherein the cells exhibit tight adherence to each other and the ability to form tight junctions which form a barrier that maintains stromal dehydration. Mature CEC exhibit a high level of pump function due in part to the tight adherence of mature CEC to each other, the ability to form tight junctions, the number of tight junctions between the cells and expression of proteins which regulate the corneal endothelial pump. The tight junctions form a barrier to reduce the flow of water into the stroma and improved pump activity enhances the maintenance of the proper fluid levels in the cornea. Mature corneal endothelial cells may also exhibit resistance to oxidative stress. Mature corneal endothelial cells may express markers associated with pump function, for example, SLC4A11, and SLC4A4. Additional markers associated with pump function that may be expressed in mature corneal endothelial cells include Na+/K+ ATPase, AQP1, CA2, CA4, CA12, SCL14A2, SLC16A1, SLC16A3, SLC16A7, CFTR, NHE1, ADCY10, voltage-dependent anion channels VDAC2 and VDAC3, chloride channel proteins CLCN2 and CLC.

Mature CEC may exhibit in vivo efficacy, for example, following transplantation of mature corneal endothelial cells into a subject having a disorder of the cornea, the mature corneal endothelial cells can engraft onto the recipient cornea and form a monolayer of cells which form tight junctions. Engraftment may be achieved using methods known to one of skill in the art. For example, engraftment may be achieved by use of a bioengineered corneal graft utilizing biomaterials (see, for example, PCT Publ. No. WO 2019/198086, filed on Apr. 11, 2019). Because of the formation of tight junctions and the expression of markers associated with pump function, mature CEC in vivo can improve the pump function of the recipient cornea leading to increased clarity of the cornea. Transplanted mature CEC can also decrease the thickness of a recipient cornea and increase the clarity of the recipient cornea. Additional markers that may be expressed in mature corneal endothelial cells include but are not limited to PITX2, SLC4A11, FOXC1, COL8A1, COL8A2, TFAP2B, LMX1B, AQP1, ATP1A1, TJP1, NCAM1, CDH2, SLC4A4, CD166, POU6F2, CD248 and MRGPRX3. In an embodiment, markers that are expressed in mature corneal endothelial cells are PITX2, SLC4A11, FOXC1, COL8A1, COL8A2, TFAP2b, LMX1B and MRGPRX3. In an embodiment, markers that are expressed in mature corneal endothelial cells are PITX2, SLC4A11, FOXC1, COL8A1, COL8A2, TFAP2B and LMX1B. In an embodiment, markers that are expressed in mature corneal endothelial cells are COL8A1, COL8A2, SLC4A11 and MRGPRX3.

"Neural crest stem cells" or "NCSCs" generally refer to a neural progenitor cell having the developmental potential to produce a variety of cell types such as melanocytes, craniofacial skeleton, peripheral nervous system, glia, smooth muscle, keratocytes, and corneal endothelium. Neural crest stem cells may be differentiated from iPSC or hES cells, e.g., using dual SMAD inhibitors as described herein or as described in WO/2010/096496 or U.S. Pat. No. 9,752,118 each of which is incorporated by reference herein in its entirety. Neural crest stem cells may be differentiated from hES cells or iPSC using a combination of Wnt agonists (such as e.g., Wnt3a and/or (2'Z,3'E)-6-bromoindirubin-3'-oxime (BIG)) and SMAD inhibitors (such as SB431542 and/or Noggin); see Menendez et al., PNAS Nov. 29, 2011 vol. 108 no. 48 19240-19245. For example, efficient induction of NCSCs was reported after contacting hESCs with SB431542, and BIO (with or without Noggin), or with Wnt3a and SB431542. NCSCs may also be obtainable from cultures of neural rosettes, for example by culturing hES cells on MS5 stromal feeder cells (see Lee, et al., Stem Cells 25 (8), 1931-1393 (2007), which is incorporated by reference herein in its entirety. NCSCs are also obtainable from numerous tissues, including in developing embryos, in the neural tube, sciatic nerve, gut, and dorsal root ganglia; and in the juvenile and adult, in the dorsal root ganglia, bone marrow, skin, heart, cornea, teeth, and caratoid body. See Nagoshi et al., Journal of Cellular Biochemistry 107:1046-1052 (2009); Crane and Trainor, Annu. Rev. Cell Dev. Biol. 2006. 22:267-86; and Blum, Brain Research Bulletin 83 (2010) 189-193, each of which is incorporated by reference herein in its entirety.

Neural crest stem cells may be identified by expression of markers identified herein and known in the art. Exemplary neural crest stem cell markers include but are not limited to: SOX10, AP2, HNK1, PAX3, PAX7, and p75 (NGFR), as well as low or absent Pax6 expression. Periocular Mesenchyme (POM) is a subpopulation of neural crest cells that are positive for PITX2 and FOXC1 that may also express TFAP2B and/or LMX1B.

The term "corneal endothelial progenitor" generally refers to post-neural crest stage cells starting to acquire some features of CEC, such as the expression of early to mid CEC markers (ZO1, Na+/K+ ATPase, N-Cadherin, NCAM1, CD166, PITX2, FOXC1, COL8A1, TFAP2B, SLC4A4), and the ability to form a monolayer of polygonal or hexagonal cells. These cells do not necessarily express CEC markers at a level that is equivalent to or at the same % level of expression as mature CEC.

As used herein, the term "marker" or "cell marker" refers to a gene (e.g., as an RNA) or protein whose presence identifies a particular cell or cell type. A marker for a cell may not be limited to one marker, markers may refer to a "pattern" of markers such that a designated group of markers may identity a cell or cell type from another cell or cell type, e.g., a pattern including expression of some markers and absence or low expression of other markers indicative of other cell types. For example, a population of CEC, e.g., mature CEC may be positive for markers of CEC, e.g., mature CEC and negative for markers indicative of other cell types, such as absence of markers that are expressed on other endothelial cell types, absence of markers expressed by hES cells or iPSC, and/or absence of markers expressed by neural crest stem cells. Additionally, when marker expression is detected by cell staining methods (e.g., immunofluorescence and the like) a cell may be identified as positive for a particular marker given an expected staining pattern, such as tight junction localization of the marker ZO-1. Expression of the markers may be detected by any method known in the art, including but not limited to: Western blotting, mRNA amplification-based methods (e.g., PCR, isothermal amplification, etc., which may include reverse transcription and may be applied to detect expression from single cells or multiple cells), Northern blotting, immunostaining, etc. Additionally, expression of said markers may be inferred by expression of a reporter construct (such as a fluorescent protein whose expression may be visually detected, an antibiotic resistance gene whose expression may be detected by cell survival in the presence of the antibiotic, etc.) under the control of a genetic element that confers cell type specific expression, such as the promoter of one of the foregoing markers or a fragment thereof. Exemplary reporter constructs from the literature is the pOCT4-GFP and pOCT4-LUC genes which drive expression of GFP and luciferase, respectively, in ES cells, expression of either of which is readily detectable using conventional methodologies. Further methods of detecting marker expression that may be used are known in the art. See, generally, Ausubel, Current Protocols in Molecular Biology (Current Protocols, 1988); Ausubel et al., Short Protocols in Molecular Biology (Current Protocols; 5th Edition, 2002); Sambrook et al., Molecular Cloning: A Laboratory Manual (Cold Spring Harbor Laboratory Press, 3rd edition, 2001); Sambrook et al., The Condensed Protocols from Molecular Cloning: A Laboratory Manual (Cold Spring Harbor Laboratory Press, 2006), each of which is incorporated by reference herein in its entirety.

As used herein, "increase" or "increased", as it refers to the level of expression or activity means an increase of at least 0.1-fold, 0.2-fold, 0.5-fold, 1-fold, 2-fold, 3-fold, 4-fold, 5-fold, 10-fold, 20-fold, 50-fold, 100-fold, 200-fold, 500-fold, 1,000-fold, or 10,000-fold as compared to a control level of expression or activity. "Increased", as it refers to the level of expression or activity also means an increase of at least 5%, 10%, 15%, 20%, 25%, 30%, 35%, 40%, 45%, 50%, 55%, 60%, 65%, 79%, 75%, 80%, 85%, 90%, 95% or 100% as compared to a control level of expression or activity.

The term "increasing expression", as used herein, refers to increasing the level and/or activity of a nucleic acid, e.g., an RNA or DNA, encoding a transcription factor disclosed herein and/or increasing the level and/or activity of a transcription factor disclosed herein, relative to the endogenous nucleic acid levels and/or protein levels of the transcription factor. In some embodiments, increasing expression of the at least one transcription factor comprises contacting a cell (for example, a corneal endothelial progenitor or a pluripotent stem cell, e.g., an embryonic stem cell or an induced pluripotent stem cell), with the at least one transcription factor. In some embodiments, increasing expression of the at least one transcription factor comprises transduction of a cell (for example, a corneal endothelial progenitor or a pluripotent stem cell, e.g., an embryonic stem cell or an induced pluripotent stem cell) with a viral vector encoding the at least one transcription factor. In some embodiments, increasing expression of the at least one transcription factor comprises transfection of a cell (for example, a corneal endothelial progenitor or a pluripotent stem cell, e.g., an embryonic stem cell or an induced pluripotent stem cell) with an expression vector encoding the at least one transcription factor.

In some embodiments, increasing expression of the at least one transcription factor comprises an increase of at least 0.1-fold, 0.2-fold, 0.5-fold, 1-fold, 2-fold, 5-fold, 10-fold, 20-fold, 50-fold, 100-fold, 200-fold, 500-fold, 1,000-fold, or 10,000-fold relative to endogenous expression levels of the at least one transcription factor in a cell (for example, a corneal endothelial progenitor or a pluripotent stem cell, e.g., an embryonic stem cell or an induced pluripotent stem cell). In some embodiments, increasing expression of the at least one transcription factor comprises an increase of at least 5%, 10%, 15%, 20%, 25%, 30%, 35%, 40%, 45%, 50%, 55%, 60%, 65%, 70%, 75%, 80%, 85%, 90%, 95%, 100%, 150%, 200%, 300%, 400%, 500%, or 1000% relative to endogenous expression levels of the at least one transcription factor in a cell (for example, a corneal endothelial cell, or a pluripotent stem cell, e.g., an embryonic stem cell or an induced pluripotent stem cell).

As used herein, "decrease" or "decreased", as it refers to the level or expression or activity means a decrease of at least 0.1-fold, 0.2-fold, 0.5-fold, 1-fold, 2-fold, 3-fold, 4-fold, 5-fold, 10-fold, 20-fold, 50-fold, 100-fold, 200-fold, 500-fold, 1,000-fold, or 10,000-fold as compared to a control level of expression or activity. "Decreased" as it refers to the level of expression or activity also means an increase of at least 5%, 10%, 15%, 20%, 25%, 30%, 35%, 40%, 45%, 50%, 55%, 60%, 65%, 79%, 75%, 80%, 85%, 90%, 95% or 100% as compared to a control level of expression or activity.

Various methodologies of the instant invention include steps that involve comparing a value, level, feature, characteristic, and/or property, to a "control. A "control" may be any control or standard familiar to one of ordinary skill in the art useful for comparison purposes. In one embodiment, a "control" is a value, level, feature, characteristic, property, etc. determined prior to increasing expression of a transcription factor in a cell, e.g., a pluripotent stem cell, a corneal endothelial progenitor, CEC, e.g., mature CEC, as described herein. For example, the level of expression of the transcription factor, the level of expression of a marker of a cell of the CEC lineage, CEC, e.g., mature CEC activity or morphology, e.g., pump function, resistance to oxidative stress or tight junction formation in a population of cells may be determined prior to expressing a transcription factor in a cell, or in the absence of a transcription factor. In another embodiment, a "control" is a value, level, feature, characteristic, property, etc. determined in a cell or organism, e.g., a control or normal cell or organism, exhibiting, for example, normal traits. In yet another embodiment, a "control" is a predefined value, level, feature, characteristic, property, etc. determined prior to the expression of a transcription factor. In yet another embodiment, a "control" means a corneal endothelial progenitor which can be a control for a CEC, e.g., mature CEC.

A "control cell" may refer to a cell to which a cell expressing a transcription factor is compared. The "control cell" may not express a transcription factor. The "control cell" may have been contacted with an expression vector expressing a transcription factor under different conditions, including dosage, length of time etc., as compared to the cell for which it is a control.

The term "endogenous" as used herein refers to the native form of a nucleic acid, polynucleotide, oligonucleotide, DNA, RNA, gene, peptide or polypeptide in its natural location in a cell or in the genome of a cell.

As used herein, "exogenous" refers to a nucleic acid, polynucleotide, oligonucleotide, DNA, RNA, gene, peptide or polypeptide originating from outside of a cell or outside of the genome of a cell.

The term "maturation", as used herein, refers to a process that is required for a cell, e.g., a corneal endothelial progenitor, to become more specialized and/or functional, for example, similar to its functional state in vivo. In one embodiment, the process by which corneal endothelial progenitors become CEC, e.g., mature CEC is referred to as maturation.

As used herein, the term "pluripotent stem cells", "PS cells", or "PSCs" includes embryonic stem cells, induced pluripotent stem cells, and embryo-derived pluripotent stem cells, regardless of the method by which the pluripotent stem cells are derived. Pluripotent stem cells are defined functionally as stem cells that: (a) are capable of inducing teratomas when transplanted in immunodeficient (SCID) mice; (b) are capable of differentiating to cell types of all three germ layers (e.g., can differentiate to ectodermal, mesodermal, and endodermal cell types); (c) express one or more markers of embryonic stem cells (e.g., express OCT4, alkaline phosphatase, SSEA-3 surface antigen, SSEA-4 surface antigen, NANOG, TRA-1-60, TRA-1-81, SOX2, REX1, etc.); and (d) are capable of self-renewal. The term "pluripotent" refers to the ability of a cell to form all lineages of the body or soma (i.e., the embryo proper). For example, embryonic stem cells and induced pluripotent stem cells are a type of pluripotent stem cells that are able to form cells from each of the three germs layers: the ectoderm, the mesoderm, and the endoderm. Pluripotency is a continuum of developmental potencies ranging from the incompletely or partially pluripotent cell which is unable to give rise to a complete organism to the more primitive, more pluripotent cell, which is able to give rise to a complete organism (e.g., an embryonic stem cell). Exemplary pluripotent stem cells can be generated using, for example, methods known in the art. Exemplary pluripotent stem cells include, but are not limited to, embryonic stem cells derived from the inner cell mass of blastocyst stage embryos, embryonic stem cells derived from one or more blastomeres of a cleavage stage or morula stage embryo (optionally without destroying the remainder of the embryo), induced pluripotent stem cells produced by reprogramming of somatic cells into a pluripotent state, and pluripotent cells produced from embryonic germ (EG) cells (e.g., by culturing in the presence of FGF-2, LIF and SCF). Such embryonic stem cells can be generated from embryonic material produced by fertilization or by asexual means, including somatic cell nuclear transfer (SCNT), parthenogenesis, and androgenesis.

In an embodiment, pluripotent stem cells may be genetically engineered or otherwise modified, for example, to increase longevity, potency, homing, to prevent or reduce immune responses, or to deliver a desired factor in cells that are obtained from such pluripotent cells (for example, corneal endothelial cells). For example, the pluripotent stem cell and therefore, the resulting differentiated cell, can be engineered or otherwise modified to lack or have reduced expression of beta 2 microglobulin, class I genes including HLA-A, HLA-B, HLA-C, HLA-E, HLA-F and HLA-G, TAP1, TAP2, Tapasin, CTIIA, RFX5, TRAC, or TRAB genes. As described in WO2012145384 and WO2013158292, which are herein incorporated by reference in their entireties, in some embodiments, the cell, such as a pluripotent stem cell and the resulting differentiated cell such as a mature CEC, comprises a genetically engineered disruption in a beta-2 microglobulin (B2M) gene. In some embodiments, the cell further comprises a polynucleotide capable of encoding a single chain fusion human leukocyte antigen (HLA) class I protein comprising at least a portion of the B2M protein covalently linked, either directly or via a linker sequence, to at least a portion of an HLA-1α chain. In some embodiments, the HLA-1α chain is selected from HLA-A, HLA-B, HLA-C, HLA-E, HLA-F, and HLA-G. In some embodiments, the cell comprises a genetically engineered disruption in a human leukocyte antigen (HLA) class II-related gene. In some embodiments, the HLA class II-related gene is selected from regulatory factor X-associated ankyrin-containing protein (RFXANK), regulatory factor 5 (RFX5), regulatory factor X associated protein (RFXAP), class II transactivator (CIITA), HLA-DPA (α chain), HLA-DPB (β chain), HLA-DQA, HLA-DQB, HLA-DRA, HLA-DRB, HLA-DMA, HLA-DMB, HLA-DOA, and HLA-DOB. In some embodiments, the cell comprises one or more polynucleotides encoding a single chain fusion HLA class II protein or an HLA class II protein.

The pluripotent stem cell and the resulting differentiated cell may be engineered or otherwise modified to increase expression of a gene. In an embodiment, the pluripotent stem cell may be engineered to express or increase expression of one or more of the transcription factors of the invention. There are a variety of techniques for engineering cells to modulate the expression of one or more genes (or proteins), including the use of viral vectors such as AAV vectors, zinc-finger nucleases (ZFNs), transcription activator-like effector nucleases (TALENs), and CRISPR/Cas-based methods for genome engineering, as well as the use of transcriptional and translational inhibitors such as antisense and RNA interference (which can be achieved using stably integrated vectors and episomal vectors).

The term "embryo" or "embryonic" is meant a developing cell mass that has not been implanted into the uterine membrane of a maternal host. An "embryonic cell" is a cell isolated from or contained in an embryo. This also includes blastomeres, obtained as early as the two-cell stage, or aggregated blastomeres after extraction.

The term "embryo-derived cells" (EDC), as used herein, refers broadly to morula-derived cells, blastocyst-derived cells including those of the inner cell mass, embryonic shield, or epiblast, or other pluripotent stem cells of the early embryo, including primitive endoderm, ectoderm, and mesoderm and their derivatives. "EDC" also include blastomeres and cell masses from aggregated single blastomeres or embryos from varying stages of development, but excludes human embryonic stem cells that have been passaged as cell lines.

The term "embryonic stem cells", "ES cells," or "ESCs" as used herein, refer broadly to cells isolated from the inner cell mass of blastocysts or morulae and that have been serially passaged as cell lines. The term also includes cells isolated from one or more blastomeres of an embryo, preferably without destroying the remainder of the embryo (see, e.g., Chung et al., Cell Stem Cell. 2008 Feb. 7; 2(2): 1 13-7; U.S. Pub No. 20060206953; U.S. Pub No. 2008/0057041, each of which is hereby incorporated by reference in its entirety). The ES cells may be derived from fertilization of an egg cell with sperm or DNA, nuclear transfer, parthenogenesis, or by any means to generate ES cells with homozygosity in the HLA region. ES cells may also refer to cells derived from a zygote, blastomeres, or blastocyst-staged mammalian embryo produced by the fusion of a sperm and egg cell, nuclear transfer, parthenogenesis, or the reprogramming of chromatin and subsequent incorporation of the reprogrammed chromatin into a plasma membrane to produce a cell. In an embodiment, the embryonic stem cell may be a human embryonic stem cell (or "hES cells"). In an embodiment, human embryonic stem cells are not derived from embryos over 14 days from fertilization. In another embodiment, human embryonic stem cells are not derived from embryos that have been developed in vivo. In another embodiment, human embryonic stem cells are derived from preimplantation embryos produced by in vitro fertilization.

"Induced pluripotent stem cells" or "iPS cells" or "iPSC" as used herein, generally refer to pluripotent stem cells obtained by reprogramming a somatic cell. An iPS cell may be generated by expressing or inducing expression of a combination of factors ("reprogramming factors"), for example, OCT4 (sometimes referred to as OCT 3/4), SOX2, MYC (e.g., c-MYC or any MYC variant), NANOG, LIN28, and KLF4, in a somatic cell. In an embodiment, the reprogramming factors comprise OCT4, SOX2, c-MYC, and KLF4. In another embodiment, reprogramming factors comprise OCT4, SOX2, NANOG, and LIN28. In certain embodiments, at least two reprogramming factors are expressed in a somatic cell to successfully reprogram the somatic cell. In other embodiments, at least three reprogramming factors are expressed in a somatic cell to successfully reprogram the somatic cell. In other embodiments, at least four reprogramming factors are expressed in a somatic cell to successfully reprogram the somatic cell. In another embodiment, at least five reprogramming factors are expressed in a somatic cell to successfully reprogram the somatic cell. In yet another embodiment, at least six reprogramming factors are expressed in the somatic cell, for example, OCT4, SOX2, c-MYC, NANOG, LIN28, and KLF4. In other embodiments, additional reprogramming factors are identified and used alone or in combination with one or more known reprogramming factors to reprogram a somatic cell to a pluripotent stem cell.

iPS cells may be generated using fetal, postnatal, newborn, juvenile, or adult somatic cells. Somatic cells may include, but are not limited to, fibroblasts, keratinocytes, adipocytes, muscle cells, organ and tissue cells, and various blood cells including, but not limited to, hematopoietic cells (e.g., hematopoietic stem cells). In an embodiment, the somatic cells are fibroblast cells, such as a dermal fibroblast, synovial fibroblast, or lung fibroblast, or a non-fibroblastic somatic cell.

iPS cells may be obtained from a cell bank. Alternatively, iPS cells may be newly generated by methods known in the art. iPS cells may be specifically generated using material from a particular patient or matched donor with the goal of generating tissue-matched cells. In an embodiment, iPS cells may be universal donor cells that are not substantially immunogenic.

The induced pluripotent stem cell may be produced by expressing or inducing the expression of one or more reprogramming factors in a somatic cell. Reprogramming factors may be expressed in the somatic cell by infection using a viral vector, such as, but not limited to, a lentiviral vector or a retroviral vector, or other gene editing technologies, such as CRISPR, Talen, zinc-finger nucleases (ZFNs). Also, reprogramming factors may be expressed in the somatic cell using a non-integrative vector, such as an episomal plasmid, or RNA, such as synthetic mRNA or via an RNA virus such as Sendai virus. When reprogramming factors are expressed using non-integrative vectors, the factors may be expressed in the cells using electroporation, transfection, or transformation of the somatic cells with the vectors. For example, in mouse cells, expression of four factors (OCT3/4, SOX2, c-MYC, and KLF4) using integrative viral vectors is sufficient to reprogram a somatic cell. In human cells, expression of four factors (OCT3/4, SOX2, NANOG, and LIN28) using integrative viral vectors is sufficient to reprogram a somatic cell.

Expression of the reprogramming factors may be induced by contacting the somatic cells with at least one agent, such as a small organic molecule agent, that induces expression of reprogramming factors.

The somatic cell may also be reprogrammed using a combinatorial approach wherein the reprogramming factor is expressed (e.g., using a viral vector, plasmid, and the like) and the expression of the reprogramming factor is induced (e.g., using a small organic molecule).

Once the reprogramming factors are expressed or induced in the cells, the cells may be cultured. Over time, cells with ES characteristics appear in the culture dish. The cells may be chosen and subcultured based on, for example, ES cell morphology, or based on expression of a selectable or detectable marker. The cells may be cultured to produce a culture of cells that resemble ES cells.

To confirm the pluripotency of the iPS cells, the cells may be tested in one or more assays of pluripotency. For examples, the cells may be tested for expression of ES cell markers; the cells may be evaluated for ability to produce teratomas when transplanted into SCID mice; the cells may be evaluated for ability to differentiate to produce cell types of all three germ layers.

iPS cells may be from any species. These iPS cells have been successfully generated using mouse and human cells. Furthermore, iPS cells have been successfully generated using embryonic, fetal, newborn, and adult tissue. Accordingly, one may readily generate iPS cells using a donor cell from any species. Thus, one may generate iPS cells from any species, including but not limited to, human, non-human primates, rodents (mice, rats), ungulates (cows, sheep, etc.), dogs (domestic and wild dogs), cats (domestic and wild cats such as lions, tigers, cheetahs), rabbits, hamsters, goats, elephants, panda (including giant panda), pigs, raccoon, horse, zebra, marine mammals (dolphin, whales, etc.) and the like.

"Effective amount," as used herein, refers broadly to the amount of a compound or cells that, when administered to a patient for treating a disease, is sufficient to effect such treatment for the disease. The effective amount may be an amount effective for prophylaxis, and/or an amount effective for prevention. The effective amount may be an amount effective to reduce, an amount effective to prevent the incidence of signs/symptoms, to reduce the severity of the incidence of signs/symptoms, to eliminate the incidence of signs/symptoms, to slow the development of the incidence of signs/symptoms, to prevent the development of the incidence of signs/symptoms, and/or effect prophylaxis of the incidence of signs/symptoms. The "effective amount" may vary depending on the disease and its severity and the age, weight, medical history, susceptibility, and preexisting conditions, of the patient to be treated. The term "effective amount" is synonymous with "therapeutically effective amount" for purposes of this invention.

The term "contacting" (e.g., contacting a cell, such as corneal endothelial progenitor, or a pluripotent stem cell, e.g., an embryonic stem cell or an induced pluripotent stem cell) with a transcription factor(s) according to the invention) is intended to include any way of introducing into a cell a transcription factor(s) and/or incubating the transcription factor(s) and the cell together in vitro (e.g., adding the transcription factor(s) to cells in culture). In some embodiments, the term "contacting" is not intended to include the in vivo exposure of the cell to the transcription factor(s) as disclosed herein that may occur naturally in a subject. The step of contacting a cell with a transcription factor(s) as disclosed herein can be conducted in any suitable manner. The cells may be treated in adherent culture, or in suspension culture, and the transcription factors(s) can be added substantially simultaneously (e.g., together in a cocktail) or sequentially (e.g., within 1 hour, 1 day or more from an addition of a first transcription factor). It is understood that the cells contacted with a transcription factor(s) as disclosed herein can also be simultaneously or subsequently contacted with another agent, such as a growth factor or other differentiation agent or environment to stabilize the cells, or to differentiate the cells further. In an embodiment, contacting the cell with a transcription factor includes transduction of the cell with a vector comprising a nucleic acid encoding the transcription factor(s) or transfection of the cell with an expression vector comprising a nucleic acid encoding the transcription factor(s), and may include culturing the cell under conditions known in the art, for example, for culturing the pluripotent and/or differentiated cells, for example, as further described in the Examples.

"Contacting" also refers to contacting a cell, e.g., a pluripotent stem cell, a corneal endothelial progenitor, a neural crest stem cell, a CEC, e.g., mature CEC, with an agent that modulates the expression of an inducible expression vector that expresses a transcription factor, for example an agent that activates/induces the expression of a transcription factor from a vector that comprises an inducible promoter or a vector comprising a gene switch, for example a small molecule agent.

The term "contacting" (e.g., contacting corneal endothelial progenitors or pluripotent stem cells with a transcription factor(s) according to the invention) is intended to include any way of introducing into corneal endothelial progenitors or pluripotent stem cells a transcription factor(s) and/or incubating the transcription factor(s) and corneal endothelial progenitor or pluripotent stem cell together in vitro (e.g., adding the transcription factor(s) to cells in culture). In some embodiments, the term "contacting" is not intended to include the in vivo exposure of corneal endothelial progenitors or pluripotent stem cells to the transcription factor(s) as disclosed herein that may occur naturally in a subject. The step of contacting a corneal endothelial progenitor or pluripotent stem cell with a transcription factor(s) as disclosed herein can be conducted in any suitable manner. The cells may be treated in adherent culture, or in suspension culture, and the transcription factors(s) can be added substantially simultaneously (e.g., together in a cocktail) or sequentially (e.g., within 1 hour, 1 day or more from an addition of a first transcription factor). It is understood that the cells contacted with a transcription factor(s) as disclosed herein can also be simultaneously or subsequently contacted with another agent, such as a growth factor or other differentiation agent or environment to stabilize the cells, or to differentiate the cells further. In an embodiment, contacting the corneal endothelial progenitors or pluripotent stem cells with a transcription factor includes transduction of corneal endothelial progenitors or pluripotent stem cells with a vector comprising a nucleic acid encoding the transcription factor(s) or transfection of corneal endothelial progenitors or pluripotent stem cells with an expression vector comprising a nucleic acid encoding the transcription factor(s), and may include culturing the cells under conditions known in the art, for example, for culturing the differentiated cells, for example, as further described in the Examples.

As used herein, the term "differentiation" is the process by which an unspecialized ("uncommitted") or less specialized cell acquires the features of a specialized cell such as, for example, a CEC, e.g., a mature CEC. A differentiated cell is one that has taken on a more specialized position within the lineage of a cell. For example, an iPSC or a hES cell can be differentiated into various more differentiated cell types, including a CEC, e.g., a mature CEC. In certain embodiments, differentiation of a cell is performed in vitro, and excludes in vivo differentiation.

As used herein, the term "cultured" or "culturing" refers to the placing of cells in a medium containing, among other things nutrients needed to sustain the life of the cultured cells, including any specified added substances. Cells are cultured "in the presence of" a specified substance when the medium in which such cells are maintained contains such specified substance. Culturing can take place in any vessel or apparatus in which the cells can be maintained exposed to the medium, including without limitation petri dishes, culture dishes, blood collection bags, roller bottles, flasks, test tubes, microtiter wells, hollow fiber cartridges or any other apparatus known in the art.

As used herein, the term "subculturing" or "passaging," refers to transferring some or all cells from a previous culture to fresh growth medium and/or plating onto a new culture dish and further culturing the cells. Subculturing may be done, e.g., to prolong the life, enrich for a desired cell population, and/or expand the number of cells in the culture. For example, the term includes transferring, culturing, or plating some or all cells to a new culture vessel at a lower cell density to allow proliferation of the cells.

As used herein, "administration", "administering" and variants thereof refers to introducing a composition or agent into a subject and includes concurrent and sequential introduction of a composition or agent. "Administration" can refer, e.g., to therapeutic, pharmacokinetic, diagnostic, research, placebo, and experimental methods. "Administration" also encompasses in vitro and ex vivo treatments. Administration includes self-administration and the administration by another. Administration can be carried out by any suitable route. A suitable route of administration allows the composition or the agent to perform its intended function. For example, if a suitable route is intravenous, the composition is administered by introducing the composition or agent into a vein of the subject.

As used herein, the terms "subject", "individual", "host", and "patient" are used interchangeably herein and refer to any mammalian subject for whom diagnosis, treatment, or therapy is desired, particularly humans. The methods described herein are applicable to both human therapy and veterinary applications. In some embodiments, the subject is a mammal, and in particular embodiments the subject is a human.

As used herein, the terms "therapeutic amount", "therapeutically effective amount", an "amount effective", or "pharmaceutically effective amount" of an active agent (e.g., a CEC, e.g., a mature CEC) are used interchangeably to refer to an amount that is sufficient to provide the intended benefit of treatment. However, dosage levels are based on a variety of factors, including the type of injury, the age, weight, sex, medical condition of the patient, the severity of the condition, the route of administration, anticipated cell engraftment, long term survival, and/or the particular active agent employed. Thus the dosage regimen may vary widely but can be determined routinely by a physician using standard methods. Additionally, the terms "therapeutic amount", "therapeutically effective amounts" and "pharmaceutically effective amounts" include prophylactic or preventative amounts of the compositions of the described invention. In prophylactic or preventative applications of the described invention, pharmaceutical compositions or medicaments are administered to a patient susceptible to, or otherwise at risk of, a disease, disorder or condition in an amount sufficient to eliminate or reduce the risk, lessen the severity, or delay the onset of the disease, disorder or condition, including biochemical, histologic and/or behavioral symptoms of the disease, disorder or condition, its complications, and intermediate pathological phenotypes presenting during development of the disease, disorder or condition. It is generally preferred that a maximum dose be used, that is, the highest safe dose according to some medical judgment. The terms "dose" and "dosage" are used interchangeably herein.

As used herein the term "therapeutic effect" refers to a consequence of treatment, the results of which are judged to be desirable and beneficial. A therapeutic effect can include, directly or indirectly, the arrest, reduction, or elimination of a disease manifestation. A therapeutic effect can also include, directly or indirectly, the arrest reduction or elimination of the progression of a disease manifestation.

For the therapeutic agents described herein (e.g., CEC, e.g., a mature CEC), a therapeutically effective amount may be initially determined from preliminary in vitro studies and/or animal models. A therapeutically effective dose may also be determined from human data. The applied dose may be adjusted based on the relative bioavailability and potency of the administered compound. Adjusting the dose to achieve maximal efficacy based on the methods described above and other well-known methods is within the capabilities of the ordinarily skilled artisan.

Pharmacokinetic principles provide a basis for modifying a dosage regimen to obtain a desired degree of therapeutic efficacy with a minimum of unacceptable adverse effects. In situations where the agent's plasma concentration can be measured and related to a therapeutic window, additional guidance for dosage modification can be obtained.

As used herein, the terms "treat", "treating", and/or "treatment" include abrogating, substantially inhibiting, slowing or reversing the progression of a condition, substantially ameliorating clinical symptoms of a condition, or substantially preventing the appearance of clinical symptoms of a condition (e.g., a pathological condition), obtaining beneficial or desired clinical results. Treating further refers to accomplishing one or more of the following: (a) reducing the severity of the disorder; (b) limiting development of symptoms characteristic of the disorder(s) being treated; (c) limiting worsening of symptoms characteristic of the disorder(s) being treated; (d) limiting recurrence of the disorder(s) in patients that have previously had the disorder(s); and (e) limiting recurrence of symptoms in patients that were previously asymptomatic for the disorder(s).

Beneficial or desired clinical results, such as pharmacologic and/or physiologic effects include, but are not limited to, preventing the disease, disorder or condition from occurring in a subject that may be predisposed to the disease, disorder or condition but does not yet experience or exhibit symptoms of the disease (prophylactic treatment), alleviation of symptoms of the disease, disorder or condition, diminishment of extent of the disease, disorder or condition, stabilization (i.e., not worsening) of the disease, disorder or condition, preventing spread of the disease, disorder or condition, delaying or slowing of the disease, disorder or condition progression, amelioration or palliation of the disease, disorder or condition, and combinations thereof, as well as prolonging survival as compared to expected survival if not receiving treatment.

"Signs" of disease, as used herein, refers broadly to any abnormality indicative of disease, discoverable on examination of the patient; an objective indication of disease, in contrast to a symptom, which is a subjective indication of disease.

"Symptoms" of disease as used herein, refers broadly to any morbid phenomenon or departure from the normal in structure, function, or sensation, experienced by the patient and indicative of disease.

I. Methods of the Invention

The present invention is based on the discovery of methods which include increasing expression of at least one transcription factor selected from the group consisting of PITX2, FOXC1, TFAP2B, LMX1B and POU6F2, to promote the maturation of CEC, e.g., a mature CEC, and thereby allow the production of mature and functional CEC. The methods of the invention are efficient and effective, and result in production of CEC, e.g., mature CEC, for example, from pluripotent stem cells, that can be used for a variety of applications disclosed herein, for example, treatment of diseases or disorders affecting CEC or amenable to treatment by the transplantation or administration thereof, including, for example, primary diseases such as Fuch's dystrophy, iridocorneal endothelial syndrome, posterior polymorphous dystrophy, and congenital hereditary endothelial dystrophy, and secondary diseases for which an effective treatment is replacement of the corneal endothelium including corneal dystrophies, or wherein a subject exhibits symptoms of corneal edema leading to Bullous Keratopathy, wherein a subject has ocular damage due to contact lens usage or cataract surgery, or wherein a subject is considering corneal transplantation.

In some embodiments, increasing the expression of PITX2 comprises an increase of at least 0.1-fold, 0.2-fold, 0.5-fold, 1-fold, 2-fold, 5-fold, 10-fold, 20-fold, 50-fold, 100-fold, 200-fold, 500-fold, 1,000-fold, or 10,000-fold relative to endogenous expression levels of PITX2 in the corneal endothelial progenitors.

In some embodiments, increasing the expression of FOXC1 comprises an increase of at least 0.1-fold, 0.2-fold, 0.5-fold, 1-fold, 2-fold, 5-fold, 10-fold, 20-fold, 50-fold, 100-fold, 200-fold, 500-fold, 1,000-fold, or 10,000-fold relative to endogenous expression levels of FOXC1 in the corneal endothelial progenitors.

In some embodiments, increasing the expression of TFAP2B comprises an increase of at least 0.1-fold, 0.2-fold, 0.5-fold, 1-fold, 2-fold, 5-fold, 10-fold, 20-fold, 50-fold, 100-fold, 200-fold, 500-fold, 1,000-fold, or 10,000-fold relative to endogenous expression levels of TFAP2B in the corneal endothelial progenitors.

In some embodiments, increasing the expression of LMX1B comprises an increase of at least 0.1-fold, 0.2-fold, 0.5-fold, 1-fold, 2-fold, 5-fold, 10-fold, 20-fold, 50-fold, 100-fold, 200-fold, 500-fold, 1,000-fold, or 10,000-fold relative to endogenous expression levels of LMX1B in the corneal endothelial progenitors.

In some embodiments, increasing the expression of POU6F2 comprises an increase of at least 0.1-fold, 0.2-fold, 0.5-fold, 1-fold, 2-fold, 5-fold, 10-fold, 20-fold, 50-fold, 100-fold, 200-fold, 500-fold, 1,000-fold, or 10,000-fold relative to endogenous expression levels of POU6F2 in the corneal endothelial progenitors.

In some embodiments, the corneal endothelial progenitors comprise an expression vector comprising a nucleic acid encoding the at least one transcription factor.

In some embodiments, increasing the expression of the at least one transcription factor in the corneal endothelial progenitors comprises inducing expression of the at least one transcription factor in the corneal endothelial progenitors.

In some embodiments, the corneal endothelial progenitors are derived from pluripotent stem cells, e.g., induced pluripotent stem cells or embryonic stem cells. Any method for differentiating pluripotent cells into corneal endothelial progenitors may be used. For example, corneal endothelial progenitors may be obtained by differentiating pluripotent stem cells as described herein.

In some embodiments, the pluripotent stem cells may be engineered to comprise an expression vector comprising a nucleic acid encoding the at least one transcription factor. In some embodiments, the expression vector comprises a promoter, e.g., an endogenous promoter, an artificial promoter or an inducible promoter, operably linked to a nucleic acid encoding the at least one transcription factor.

Cells for Generating Corneal Endothelial Cells

In certain embodiments of the invention, there are disclosed methods and compositions for producing CEC, e.g., mature CEC by increasing expression of at least one transcription factor selected from the group consisting of PITX2, FOXC1, TFAP2B, LMX1B and POU6F2 in corneal endothelial progenitors. In some embodiments, the CEC, e.g., a mature CEC and corneal endothelial progenitors are derived from pluripotent stem cells, for example, induced pluripotent stem cells, embryonic stem cells, fetal stem cells, and/or adult stem cells. In further embodiments, the CEC, e.g., mature CEC and corneal endothelial progenitors may be derived from somatic cells.

A. Stem Cells

In a developing embryo, stem cells can differentiate into all of the specialized embryonic tissues. In adult organisms, stem cells and progenitor cells act as a repair system for the body, replenishing specialized cells, but also maintain the normal turnover of regenerative organs, such as blood, skin or intestinal tissues.

Pluripotent stem cells such as human embryonic stem cells (ESCs) and induced pluripotent stem cells (iPSC) are capable of long-term proliferation in vitro, while retaining the potential to differentiate into all cell types of the body, including corneal endothelial progenitors. Thus these cells could potentially provide an unlimited supply of patient-specific functional CEC for both drug development and transplantation therapies. The differentiation of pluripotent stem cells to CEC, e.g., mature CEC in vitro may involve the addition of different growth factors at different stages of differentiation and may require about 10-30 days of differentiation (see e.g. FIG. 1). Pluripotent stem cells, with their unlimited proliferation ability, provide an advantage over somatic cells as the starting cell population for CEC differentiation.

Pluripotent stem cells, e.g., embryonic stem (ES) cells or iPS cells, may be the starting material of the disclosed method. In any of the embodiments herein, the pluripotent stem cell may be human pluripotent stem cells (hPSCs). Pluripotent stem cells (PSCs) may be cultured in any way known in the art, such as in the presence or absence of feeder cells. Additionally, PSCs produced using any method can be used as the starting material to produce CEC, e.g., mature CEC. For example, the hES cells may be derived from blastocyst stage embryos that were the product of in vitro fertilization of egg and sperm. Alternatively, the hES cells may be derived from one or more blastomeres removed from an early cleavage stage embryo, optionally, without destroying the remainder of the embryo. In still other embodiments, the hES cells may be produced using nuclear transfer. In a further embodiment, iPSCs may be used. As a starting material, previously cryopreserved PSCs may be used. In another embodiment, PSCs that have never been cryopreserved may be used.

In one aspect of the present invention, PSCs are plated onto an extracellular matrix under feeder or feeder-free conditions. In an embodiment, the PSCs can be cultured on an extracellular matrix, including, but not limited to, laminin, fibronectin, vitronectin, Matrigel, CellStart, collagen, or gelatin. In some embodiments, the extracellular matrix is laminin with or without e-cadherin. In some embodiments, laminin may be selected from the group comprising laminin 521, laminin 511, or iMatrix511. In some embodiments, the feeder cells are human feeder cells, such as human dermal fibroblasts (HDF). In other embodiments, the feeder cells are mouse embryo fibroblasts (MEF).

In certain embodiments, the media used when culturing the PSCs may be selected from any media appropriate for culturing PSCs. In some embodiments, any media that is capable of supporting PSC cultures may be used. For example, one of skill in the art may select amongst commercially available or proprietary media.

The medium that supports pluripotency may be any such medium known in the art. In some embodiments, the medium that supports pluripotency is Nutristem™. In some embodiments, the medium that supports pluripotency is TeSR™. In some embodiments, the medium that supports pluripotency is StemFit™. In other embodiments, the medium that supports pluripotency is Knockout™ DMEM (Gibco), which may be supplemented with Knockout™ Serum Replacement (Gibco), LIF, bFGF, or any other factors. Each of these exemplary media is known in the art and commercially available. In further embodiments, the medium that supports pluripotency may be supplemented with ROCK inhibitor, bFGF or any other factors. In an embodiment, bFGF may be supplemented at a low concentration (e.g., 4 ng/mL). In another embodiment, bFGF may be supplemented at a higher concentration (e.g., 100 ng/mL), which may prime the PSCs for differentiation.

The concentration of PSCs to be used in the production method of the present invention is not particularly limited. For example, when a 10 cm dish is used, $1\times10^4$-$1\times10^8$ cells per dish, preferably $5\times10^4$-$5\times10^6$ cells per dish, more preferably $1\times10^5$-$1\times10^7$ cells, per dish are used.

In some embodiments, the PSCs are plated with a cell density of about 1,000-100,000 cells/cm$^2$. In some embodiments, the PSCs are plated with a cell density of about 5000-100,000 cells/cm$^2$, about 5000-50,000 cells/cm$^2$, or about 5000-15,000 cells/cm$^2$. In other embodiments, the PSCs are plated at a density of about 10,000 cells/cm$^2$.

In some embodiments, the medium that supports pluripotency, e.g., StemFit™ or other similar medium, is replaced with a differentiation medium to differentiate the cells into neural crest stem cells or corneal endothelial progenitors. In some embodiments, replacement of the media from the medium that supports pluripotency to a differentiation medium may be performed at different time points during the cell culture of PSCs and may also depend on the initial plating density of the PSCs. In some embodiments, replacement of the media can be performed after 2-14 days of culture of the PSCs in the pluripotency medium. In some embodiments, replacement of the media may be performed at day 2, 3, 4, 5, 6, 7, 8, 9, 10, 11, 12, 13, or 14.

In some embodiments, the stem cells useful for the method described herein include but not limited to embryonic stem cells, induced pluripotent stem cells, mesenchymal stem cells, bone-marrow derived stem cells, hematopoietic stem cells, chondrocyte progenitor cells, epidermal stem cells, gastrointestinal stem cells, neural stem cells, hepatic stem cells, adipose-derived mesenchymal stem cells, pancreatic progenitor cells, hair follicular stem cells, endothelial progenitor cells and smooth muscle progenitor cells.

In some embodiments, the stem cells used for the method described herein are isolated from umbilical cord, placenta, amniotic fluid, chorion villi, blastocysts, bone marrow, adipose tissue, brain, peripheral blood, the gastrointestinal tract, cord blood, blood vessels, skeletal muscle, skin, liver and menstrual blood.

The detailed procedures for the isolation of human stem cells from various sources are described in Current Protocols in Stem Cell Biology (2007), which is incorporated by reference in its entirety herein. Methods of isolating and culturing stem cells from various sources are also described in U.S. Pat. Nos. 5,486,359, 6,991,897, 7,015,037, 7,422,736, 7,410,798, 7,410,773, 7,399,632; each of which is incorporated by reference in its entirety herein.

B. Somatic Cells

In certain aspects of the invention, there may also be provided methods of transdifferentiation, i.e., the direct conversion of one somatic cell type into another, e.g., deriving CEC, e.g., mature CEC from other somatic cells. Transdifferentiation may involve the use of CEC differentiation transcription factor genes or gene products to increase expression levels of such genes in somatic cells for production of CEC, e.g., mature CEC.

However, human somatic cells may be limited in supply, especially those from living donors. In order to provide an unlimited supply of starting cells for CEC differentiation, somatic cells may be immortalized by introduction of immortalizing genes or proteins, such as hTERT and/or other oncogenes. The immortalization of cells may be reversible (e.g., using removable expression cassettes) or inducible (e.g., using inducible promoters).

Somatic cells in certain aspects of the invention may be primary cells (non-immortalized cells), such as those freshly isolated from an animal, or may be derived from a cell line (immortalized cells). The cells may be maintained in cell culture following their isolation from a subject. In certain embodiments the cells are passaged once or more than once (e.g., between 2-5, 5-10, 10-20, 20-50, 50-100 times, or more) prior to their use in a method of the invention. In some embodiments the cells will have been passaged no more than 1, 2, 5, 10, 20, or 50 times prior to their use in a method of the invention.

The somatic cells used or described herein may be native somatic cells, or engineered somatic cells, i.e., somatic cells which have been genetically altered. Somatic cells of the present invention are typically mammalian cells, such as, for example, human cells, primate cells or mouse cells. They may be obtained by well-known methods and can be obtained from any organ or tissue containing live somatic cells, e.g., blood, bone marrow, skin, lung, pancreas, liver, stomach, intestine, heart, reproductive organs, bladder, kidney, urethra and other urinary organs, etc.

Mammalian somatic cells useful in the present invention include, but are not limited to, Sertoli cells, endothelial cells, granulosa epithelial cells, neurons, pancreatic islet cells, epidermal cells, epithelial cells, hepatocytes, hair follicle cells, keratinocytes, hematopoietic cells, melanocytes, chondrocytes, lymphocytes (B and T lymphocytes), erythrocytes, macrophages, monocytes, mononuclear cells, cardiac muscle cells, and other muscle cells, etc.

Methods described herein may be used to program one or more somatic cells, e.g., colonies or populations of somatic cells into CEC, e.g., mature CEC. In some embodiments a population of cells of the present invention is substantially uniform in that at least 90% of the cells display a phenotype or characteristic of interest. In some embodiments at least 95%, 96%, 97%, 98%, 99%, 99.5%, 99.8%, 99.9, 99.95% or more of the cells display a phenotype or characteristic of interest. In certain embodiments of the invention the somatic cells have the capacity to divide, i.e., the somatic cells are not post-mitotic.

Somatic cells may be partially or completely differentiated. As described herein, both partially differentiated somatic cells and fully differentiated somatic cells can be differentiated to produce corneal endothelial cells.

Transcription Factors for Use in the Methods of the Invention

CEC, e.g., mature CEC can be generated by increasing the expression in corneal endothelial progenitors of at least one transcription factor described herein. Any transcription factor important for promoting CEC, maturation or function may be used, for example, at least one transcription factor selected from the transcription factors described in Table 1. All the isoforms and variants of the transcription factors listed in Table 1 may be included in this invention. Non-limiting examples of accession numbers for certain isoforms or variants of the transcription factors of the invention are described in Table 1.

TABLE 1

Transcription Factors for Generating Mature Corneal Endothelial Cells

| Transcription Factor | Accession No. | mRNA SEQ ID NO. | Amino Acid SEQ ID NO. |
|---|---|---|---|
| PITX2 isoform 1 | NM_153427 | 1 | 51 |
| PITX2 isoform 2 | NM_001204397 | 2 | 52 |
| PITX2 isoform 3 | NM_001204398 | 3 | 52 |
| PITX2 isoform 4 | NM_001204399 | 4 | 51 |
| PITX2 isoform 5 | NM_000325 | 5 | 53 |
| PITX2 isoform 6 | NM_153426 | 6 | 52 |
| FOXC1 | NM_001453 | 7 | 54 |
| TFAP2B | NM_003221 | 8 | 55 |
| LMX1B isoform 1 | NM_001174146 | 9 | 56 |
| LMX1B isoform 2 | NM_002316 | 10 | 57 |
| LMX1B isoform 3 | NM_001174147 | 11 | 58 |
| POU6F2 isoform 1 | NM_007252 | 12 | 59 |
| POU6F2 isoform 2 | NM_001166018 | 13 | 60 |
| ATF4 | NM_182810 | 14 | 61 |
| ATMIN | NM_015251 | 15 | 62 |
| BHLHE40 | NM_003670 | 16 | 63 |
| CEBPD | NM_005195 | 17 | 64 |
| CSRNP1 | NM_033027 | 18 | 65 |
| DRAP1 | NM_006442 | 19 | 66 |
| EGR1 | NM_001964 | 20 | 67 |
| ELF2 | NM_201999 | 21 | 68 |
| EMX2 | NM_004098 | 22 | 69 |
| ESRRA | NM_004451 | 23 | 70 |
| ETS 2 | NM_005239 | 24 | 71 |
| FOS | NM_005252 | 25 | 72 |
| FOSB | NM_006732 | 26 | 73 |
| FOSL2 | NM_005253 | 27 | 74 |
| GTF3A | NM_002097 | 28 | 75 |
| HIF1A | NM_001530 | 29 | 76 |
| JUN | NM_002228 | 30 | 77 |
| JUNB | NM_002229 | 31 | 78 |
| JUND | NM_001286968 | 32 | 79 |
| KLF10 | NM_005655 | 33 | 80 |
| KLF9 | NM_001206 | 34 | 81 |
| MBD3 | NM_001281454 | 35 | 82 |
| NFE2L1 | NM_003204 | 36 | 83 |
| NME2 | NM_002512 | 37 | 84 |
| NR1D1 | NM_021724 | 38 | 85 |
| NR4A1 | NM_173157 | 39 | 86 |
| PA2G4 | NM_006191 | 40 | 87 |
| POU3F3 | NM_006236 | 41 | 88 |
| RELA | NM_021975 | 42 | 89 |
| TBX2 | NM_005994 | 43 | 90 |
| TFAP2B | NM_003221 | 8 | 55 |
| TFDP1 | NM_007111 | 44 | 91 |
| TSC22D1 | NM_006022 | 45 | 92 |
| USF2 | NM_003367 | 46 | 93 |
| YBX1 | NM_004559 | 47 | 94 |
| ZNF207 | NM_001098507 | 48 | 95 |
| ZNF358 | NM_018083 | 49 | 96 |
| ZNF395 | NM_018660 | 50 | 97 |

In some embodiments, the at least one transcription factor is selected from the group consisting of PITX2, FOXC1, TFAP2B, LMX1B and POU6F2.

In some embodiments, CEC, e.g., mature CEC can be generated by increasing the expression in corneal endothelial progenitors of a combination of transcription factors described herein. For example, in some embodiments, CEC, e.g., mature CEC can be generated by increasing the expression in corneal endothelial progenitors of PITX2 and at least one (e.g., 1, 2, 3, or 4) additional transcription factor described herein. In some embodiments, CEC, e.g., mature CEC can be generated by increasing the expression in corneal endothelial progenitors of FOXC1 and at least one (e.g., 1, 2, 3, or 4) additional transcription factor described herein. In some embodiments, CEC, e.g., mature CEC can be generated by increasing the expression in corneal endothelial progenitors of TFAP2B and at least one (e.g., 1, 2, 3, or 4) additional transcription factor described herein. In some embodiments, CEC, e.g., mature CEC can be generated by increasing the expression in corneal endothelial progenitors of LMX1B and at least one (e.g., 1, 2, 3, or 4) additional transcription factor described herein. In some embodiments, CEC, e.g., mature CEC can be generated by increasing the expression in corneal endothelial progenitors of POU6F2 and at least one (e.g., 1, 2, 3, or 4) additional transcription factor described herein. In some embodiments, the combination of transcription factors is selected from the combinations of transcription factors described in Table 1A:

TABLE 1A

Examples of Combinations of Transcription Factors.

| | | | |
|---|---|---|---|
| PITX2 + FOXC1 | PITX2 + FOXC1 + TFAP2B | PITX2 + FOXC1 + TFAP2B + LMX1B | PITX2 + FOXC1 + TFAP2B + LMX1B + POU6F2 |
| PITX2 + TFAP2B | PITX2 + FOXC1 + LMX1B | PITX2 + FOXC1 + TFAP2B + POU6F2 | |
| PITX2 + LMX1B | PITX2 + FOXC1 + POU6F2 | PITX2 + FOXC1 + LMX1B + POU6F2 | |
| PITX2 + POU6F2 | PITX2 + TFAP2B + LMX1B | PITX2 + TFAP2B + LMX1B + POU6F2 | |
| FOXC1 + TFAP2B | PITX2 + TFAP2B + POU6F2 | FOXC1 + TFAP2B + LMX1B + POU6F2 | |
| FOXC1 + LMX1B | PITX2 + LMX1B + POU6F2 | | |
| FOXC1 + POU6F2 | FOXC1 + TFAP2B + LMX1B | | |
| TFAP2B + LMX1B | FOXC1 + TFAP2B + POU6F2 | | |
| TFAP2B + POU6F2 | FOXC1 + LMX1B + POU6F2 | | |
| LMX1B + POU6F2 | TFAP2B + LMX1B + POU6F2 | | |

In some embodiments, the transcription factor is Paired-Like Homeodomain transcription Factor 2 (PITX2). As used herein, "PITX2" refers to the well-known gene and protein. The term PITX2 includes protein isoforms and alternatively spliced or transcript variants. PITX2 is also known as pituitary homeobox 2, ARP1, Brx1, IDG2, IGDS, IGDS21, IHG2, IRID2, Otlx2, PTX2, RGS, RIEG, RIEG1, RS, paired like homeodomain 2 and ASGD4. The protein encoded by the PITX2 gene is a transcription factor that regulates procollagen lysyl hydroxylase gene expression and is involved in the development of the eye, tooth and abdominal organs. The sequence of a human PITX2 mRNA transcript can be found at National Center for Biotechnology Information (NCBI) Ref Seq accession number NM_153427 (SEQ ID NO: 1). PITX2 isoforms include PITX2 isoform 2 (NM_001204397, SEQ ID NO: 2), PITX2 isoform 3 (NM_001204398, SEQ ID NO: 3), PITX2 isoform 4 (NM_001204399, SEQ ID NO: 4), PITX2 isoform 5 (NM_000325, SEQ ID NO: 5) and PITX2 isoform 6 (NM_153426, SEQ ID NO: 6).

Additional examples of PITX2 mRNA sequences are readily available using publicly available databases, e.g., GenBank, UniProt, and OMIM.

An exemplary sequence of PITX2 comprises the nucleotide sequence of any one of SEQ ID NOs: 1, 2, 3, 4, 5 or 6, or an amino acid sequence encoded therefrom. In some embodiments, PITX2 comprises a nucleotide sequence that is at least 80%, at least 85%, at least 90%, at least 91%, at least 92%, at least 93%, at least 94%, at least 95%, at least 96%, at least 97%, at least 98%, at least 99% or 100% identical to the nucleotide sequence of any one of SEQ ID NOs: 1, 2, 3, 4, 5, or 6. In some embodiments, PITX2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NO: 1.

In some embodiments, the methods of the invention are directed to increasing the expression of PITX2 by at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of PITX2 in corneal endothelial progenitors. In some embodiments, the increased expression of PITX2 comprises an increase of at least 0.1-fold relative to endogenous expression levels of PITX2 in the corneal endothelial progenitors. In some embodiments, the increased expression of PITX2 comprises an increase of at least 0.2-fold relative to endogenous expression levels of PITX2 in the corneal endothelial progenitors. In some embodiments, the increased expression of PITX2 comprises an increase of at least 0.5-fold relative to endogenous expression levels of PITX2 in the corneal endothelial progenitors. In some embodiments, the increased expression of Pitx2 comprises an increase of at least 1-fold relative to endogenous expression levels of PITX2 in the corneal endothelial progenitors. In some embodiments, the increased expression of PITX2 comprises an increase of at least 2-fold relative to endogenous expression levels of PITX2 in the corneal endothelial progenitors. In some embodiments, the increased expression of PITX2 comprises an increase of at least 5-fold relative to endogenous expression levels of PITX2 in the corneal endothelial progenitors. In some embodiments, the increased expression of PITX2 comprises an increase of at least 10-fold relative to endogenous expression levels of PITX2 in the corneal endothelial progenitors. In some embodiments, the increased expression of PITX2 comprises an increase of at least 20-fold relative to endogenous expression levels of PITX2 in the corneal endothelial progenitors. In some embodiments, the increased expression of PITX2 comprises an increase of at least 50-fold relative to endogenous expression levels of PITX2 in the corneal endothelial progenitors. In some embodiments, the increased expression of PITX2 comprises an increase of at least 100-fold relative to endogenous expression levels of PITX2 in the corneal endothelial progenitors. In some embodiments, the increased expression of PITX2 comprises an increase of at least 200-fold relative to endogenous expression levels of PITX2 in the corneal endothelial progenitors. In some embodiments, the increased expression of PITX2 comprises an increase of at least 500-fold relative to endogenous expression levels of PITX2 in the corneal endothelial progenitors. In some embodiments, the increased expression of PITX2 comprises an increase of at least 1,000-fold relative to endogenous expression levels of PITX2 in the corneal endothelial progenitors. In some embodiments, the increased expression of PITX2 comprises an increase of at least 10,000-fold relative to endogenous expression levels of PITX2 in the corneal endothelial progenitors.

In some embodiments, the transcription factor is Forkhead box C1 (FOXC1). As used herein, "FOXC1" refers to the well-known gene and protein. The term FOXC1 includes protein isoforms or alternatively spliced or transcript variants. FOXC1 is also known as ARA, FKHL7, FREAC-3, FREAC3, IGDA, IHG1, IRID1, RIEG3, forkhead box C1, ASGD3. The protein encoded by the FOXC1 gene is a transcription factor that plays a role in regulation of embryonic and ocular development. The sequence of a human FOXC1 mRNA transcript can be found at National Center for Biotechnology Information (NCBI) Ref Seq accession number NM_001453 (SEQ ID NO: 7). Additional examples of FOXC1 mRNA sequences are readily available using publicly available databases, e.g., GenBank, UniProt, and OMIM.

An exemplary sequence of FOXC1 comprises the nucleotide sequence of SEQ ID NO: 7, or an amino acid sequence encoded therefrom. In some embodiments FOXC1, comprises a nucleotide sequence that is at least 80%, at least 85%, at least 90%, at least 91%, at least 92%, at least 93%, at least 94%, at least 95%, at least 96%, at least 97%, at least 98%, at least 99% or 100% identical to the nucleotide sequence of SEQ ID NO: 7. In some embodiments, FOXC1 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NO: 7.

In some embodiments, the methods of the invention are directed to increasing the expression of FOXC1 by at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of FOXC1 in corneal endothelial progenitors. In some embodiments, the increased expression of FOXC1 comprises an increase of at least 0.1-fold relative to endogenous expression levels of FOXC1 in the corneal endothelial progenitors. In some embodiments, the increased expression of FOXC1 comprises an increase of at least 0.2-fold relative to endogenous expression levels of FOXC1 in the corneal endothelial progenitors. In some embodiments, the increased expression of FOXC1 comprises an increase of at least 0.5-fold relative to endogenous expression levels of FOXC1 in the corneal endothelial progenitors. In some embodiments, the increased expression of FOXC1 comprises an increase of at least 1-fold relative to endogenous expression levels of FOXC1 in the corneal endothelial progenitors. In some embodiments, the increased expression of FOXC1 comprises an increase of at least 2-fold relative to endogenous expression levels of FOXC1 in corneal endothelial progenitors. In some embodiments, the increased expression of FOXC1 comprises an increase of at least 5-fold relative to endogenous expression levels of FoxC1 in the corneal endothelial progenitors. In some embodiments, the increased expression of FOXC1 comprises an increase of at least 10-fold relative to endogenous expression levels of FOXC1 in the corneal endothelial progenitors. In some embodiments, the increased expression of FOXC1 comprises an increase of at least 20-fold relative to endogenous expression levels of FOXC1 in the corneal endothelial progenitors. In some embodiments, the increased expression of FOXC1 comprises an increase of at least 50-fold relative to endogenous expression levels of FOXC1 in the corneal endothelial progenitors. In some embodiments, the increased expression of FOXC1 comprises an increase of at least 100-fold relative to endogenous expression levels of FOXC1 in the corneal endothelial progenitors. In some embodiments, the increased expression of FOXC1 comprises an increase of at least 200-fold relative to endogenous expression levels of FOXC1 in the corneal endothelial progenitors. In some embodiments, the increased expression of FOXC1 comprises an increase of at least 500-fold relative to endogenous expression levels of FOXC1 in the corneal endothelial progenitors. In some embodiments, the increased expression of FOXC1 comprises an increase of at least 1,000-fold relative to endogenous expression levels of FOXC1 in the corneal endothelial progenitors. In some embodiments, the increased expression of FOXC1 comprises an increase of at least 10,000-fold relative to endogenous expression levels of FOXC1 in the corneal endothelial progenitors.

In some embodiments, the transcription factor is Transcription Factor AP-2 Beta (TFAP2B). As used herein, "TFAP2B" refers to the well-known gene and protein. TFAP2B is also known as AP-2B, AP2-B, transcription factor AP-2 beta, PDA2. The term TFAP2B includes alternatively spliced or transcript variants (e.g., TFAP2B transcript variants X) and protein isoforms. The protein encoded by the TFAP2B gene (AP2-beta) is a transcription factor that is thought to stimulate cell proliferation and suppress terminal differentiation of specific cell types during embryonic development. The sequence of a human TFAP2B mRNA transcript can be found at National Center for Biotechnology Information (NCBI) Ref Seq accession number NM_003221 (SEQ ID NO: 8). Additional examples of TFAP2B mRNA sequences are readily available using publicly available databases, e.g., GenBank, UniProt, and OMIM.

An exemplary sequence of TFAP2B comprises the nucleotide sequence of SEQ ID NO: 8, or an amino acid sequence encoded therefrom. In some embodiments, TFAP2B comprises a nucleotide sequence that is at least 80%, at least 85%, at least 90%, at least 91%, at least 92%, at least 93%, at least 94%, at least 95%, at least 96%, at least 97%, at least 98%, at least 99% or 100% identical to the nucleotide sequence of SEQ ID NO: 8. In some embodiments, TFAP2B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NO: 8.

In some embodiments, the methods of the invention are directed to increasing the expression of TFAP2B by at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of TFAP2B in corneal endothelial progenitors. In some embodiments, the increased expression of TFAP2B comprises an increase of at least 0.1-fold relative to endogenous expression levels of TFAP2B in the corneal endothelial progenitors. In some embodiments, the increased expression of TFAP2B comprises an increase of at least 0.2-fold relative to endogenous expression levels of TFAP2B in the corneal endothelial progenitors. In some embodiments, the increased expression of TFAP2B comprises an increase of at least 0.5-fold relative to endogenous expression levels of TFAP2B in the corneal endothelial progenitors. In some embodiments, the increased expression of TFAP2B comprises an increase of at least 1-fold relative to endogenous expression levels of TFAP2B in the corneal endothelial progenitors. In some embodiments, the increased expression of TFAP2B comprises an increase of at least 2-fold relative to endogenous expression levels of TFAP2B in the corneal endothelial progenitors. In some embodiments, the increased expression of TFAP2B comprises an increase of at least 5-fold relative to endogenous expression levels of TFAP2B in the corneal endothelial progenitors. In some embodiments, the increased expression of TFAP2B comprises an increase of at least 10-fold relative to endogenous expression levels of TFAP2B in the corneal endothelial progenitors. In some embodiments, the increased expression of TFAP2B comprises an increase of at least 20-fold relative to endogenous expression levels of TFAP2B in the corneal endothelial progenitors. In some embodiments, the increased expression of TFAP2B comprises an increase of at least 50-fold relative to endogenous expression levels of TFAP2B in the corneal endothelial progenitors. In some embodiments, the increased expression of TFAP2B comprises an increase of at least 100-fold relative to endogenous expression levels of TFAP2B in the corneal endothelial progenitors. In some embodiments, the increased expression of TFAP2B comprises an increase of at least 200-fold relative to endogenous expression levels of TFAP2B in the corneal endothelial progenitors. In some embodiments, the increased expression of TFAP2B comprises an increase of at least 500-fold relative to endogenous expression levels of TFAP2B in the corneal endothelial progenitors. In some embodiments, the increased expression of TFAP2B comprises an increase of at least 1,000-fold relative to endogenous expression levels of TFAP2B in the corneal endothelial progenitors. In some embodiments, the increased expression of TFAP2B comprises an increase of at least 10,000-fold relative to endogenous expression levels of TFAP2B in the corneal endothelial progenitors.

In some embodiments, the transcription factor is LIM Homeobox Transcription Factor 1 Beta (LMX1B). As used herein, "LMX1B" refers to the well-known gene and protein. The term LMX1B includes protein isoforms and alternatively spliced or transcript variants. LMX1B is also known as LMX1.2, NPS1, LIM homeobox transcription factor 1 beta, FSGS10. The protein encoded by the LMX1B gene is a transcription factor that plays a key role in dorso-ventral patterning of the vertebrate limb. The sequence of a human LMX1B mRNA transcript can be found at National Center for Biotechnology Information (NCBI) Ref Seq accession number NM_001174146 (SEQ ID NO: 9). LMX1B isoforms include LMX1B isoform 2 (NM_002316, SEQ ID NO: 10) and LMX1B isoform 3 (NM_00117, SEQ ID NO: 11). Additional examples of LMX1B mRNA sequences are readily available using publicly available databases, e.g., GenBank, UniProt, and OMIM.

An exemplary sequence of LMX1B comprises the nucleotide sequence of any one of SEQ ID NOs: 9-11 and the amino acid sequences encoded therefrom. In some embodiments, LMX1B comprises a nucleotide sequence that is at least 80%, at least 85%, at least 90%, at least 91%, at least 92%, at least 93%, at least 94%, at least 95%, at least 96%, at least 97%, at least 98%, at least 99% or 100% identical to the nucleotide sequence of any one of SEQ ID NOs: 9-11. In some embodiments, LMX1B comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NOs: 9-11.

In some embodiments, the methods of the invention are directed to increasing the expression of LMX1B by at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of LMX1B in corneal endothelial progenitors. In some embodiments, the increased expression of LMX1B comprises an increase of at least 0.1-fold relative to endogenous expression levels of LMX1B in the corneal endothelial progenitors. In some embodiments, the increased expression of LMX1B comprises an increase of at least 0.2-fold relative to endogenous expression levels of LMX1B in the corneal endothelial progenitors. In some embodiments, the increased expression of LMX1B comprises an increase of at least 0.5-fold relative to endogenous expression levels of LMX1B in the corneal endothelial progenitors. In some embodiments, the increased expression of LMX1B comprises an increase of at least 1-fold relative to endogenous expression levels of LMX1B in the corneal endothelial progenitors. In some embodiments, the increased expression of LMX1B comprises an increase of at least 2-fold relative to endogenous expression levels of LMX1B in the corneal endothelial progenitors. In some embodiments, the increased expression of LMX1B comprises an increase of at least 5-fold relative to endogenous expression levels of LMX1B in the corneal endothelial progenitors. In some embodiments, the increased expression of LMX1B comprises an increase of at least 10-fold relative to endogenous expression levels of LMX1B in the corneal endothelial progenitors. In some embodiments, the increased expression of LMX1B comprises an increase of at least 20-fold relative to endogenous expression levels of LMX1B in the corneal endothelial progenitors. In some embodiments, the increased expression of LMX1B comprises an increase of at least 50-fold relative to endogenous expression levels of LMX1B in the corneal endothelial progenitors. In some embodiments, the increased expression of LMX1B comprises an increase of at least 100-fold relative to endogenous expression levels of LMX1B in the corneal endothelial progenitors. In some embodiments, the increased expression of LMX1B comprises an increase of at least 200-fold relative to endogenous expression levels of LMX1B in the corneal endothelial progenitors. In some embodiments, the increased expression of LMX1B comprises an increase of at least 500-fold relative to endogenous expression levels of LMX1B in the corneal endothelial progenitors. In some embodiments, the increased expression of LMX1B comprises an increase of at least 1,000-fold relative to endogenous expression levels of LMX1B in the corneal endothelial progenitors. In some embodiments, the increased expression of LMX1B comprises an increase of at least 10,000-fold relative to endogenous expression levels of LMX1B in the corneal endothelial progenitors.

In some embodiments, the transcription factor is POU Class 6 Homeobox 2 (POU6F2). As used herein, "POU6F2"

refers to the well-known gene and protein. The term POU6F2 includes alternatively spliced or transcript variants and protein isoforms. The protein encoded by the POU6F2 gene is a transcription factor that is involved in developmental processes such as cell commitment and differentiation. The sequence of a human POU6F2 mRNA transcript can be found at National Center for Biotechnology Information (NCBI) Ref Seq accession number NM_007252 (SEQ ID NO: 12). Additional isoforms of POU6F2 include POU6F2 isoform 2 (NM_001166018, SEQ ID NO: 13). Additional examples of POU6F2 mRNA sequences are readily available using publicly available databases, e.g., GenBank, UniProt, and OMIM.

An exemplary sequence of POU6F2 comprises the nucleotide sequence of any one of SEQ ID NOs: 12-13 or an amino acid sequence encoded therefrom. In some embodiments, POU6F2 comprises a nucleotide sequence that is at least 80%, at least 85%, at least 90%, at least 91%, at least 92%, at least 93%, at least 94%, at least 95%, at least 96%, at least 97%, at least 98%, at least 99% or 100% identical to the nucleotide sequence of any one of SEQ ID NOs: 12-13. In some embodiments, POU6F2 comprises an amino acid sequence that is at least 80%, at least 85%, at least 90%, at least 91%, at least 92%, at least 93%, at least 94%, at least 95%, at least 96%, at least 97%, at least 98%, at least 99% or 100% identical to the amino acid sequence encoded by the nucleotide sequence of SEQ ID NOs: 12-13.

In some embodiments, the methods of the invention are directed to increasing the expression of POU6F2 by at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of POU6F2 in corneal endothelial progenitors. In some embodiments, the increased expression of POU6F2 comprises an increase of at least 0.1-fold relative to endogenous expression levels of POU6F2 in the corneal endothelial progenitors. In some embodiments, the increased expression of POU6F2 comprises an increase of at least 0.2-fold relative to endogenous expression levels of POU6F2 in the corneal endothelial progenitors. In some embodiments, the increased expression of POU6F2 comprises an increase of at least 0.5-fold relative to endogenous expression levels of POU6F2 in the corneal endothelial progenitors. In some embodiments, the increased expression of POU6F2 comprises an increase of at least 1-fold relative to endogenous expression levels of POU6F2 in the corneal endothelial progenitors. In some embodiments, the increased expression of POU6F2 comprises an increase of at least 2-fold relative to endogenous expression levels of POU6F2 in the corneal endothelial progenitors. In some embodiments, the increased expression of POU6F2 comprises an increase of at least 5-fold relative to endogenous expression levels of POU6F2 in the corneal endothelial progenitors. In some embodiments, the increased expression of POU6F2 comprises an increase of at least 10-fold relative to endogenous expression levels of POU6F2 in the corneal endothelial progenitors. In some embodiments, the increased expression of POU6F2 comprises an increase of at least 20-fold relative to endogenous expression levels of POU6F2 in the corneal endothelial progenitors. In some embodiments, the increased expression of POU6F2 comprises an increase of at least 50-fold relative to endogenous expression levels of POU6F2 in the corneal endothelial progenitors. In some embodiments, the increased expression of POU6F2 comprises an increase of at least 100-fold relative to endogenous expression levels of POU6F2 in the corneal endothelial progenitors. In some embodiments, the increased expression of POU6F2 comprises an increase of at least 200-fold relative to endogenous expression levels of POU6F2 in the corneal endothelial progenitors. In some embodiments, the increased expression of POU6F2 comprises an increase of at least 500-fold relative to endogenous expression levels of POU6F2 in the corneal endothelial progenitors. In some embodiments, the increased expression of POU6F2 comprises an increase of at least 1,000-fold relative to endogenous expression levels of POU6F2 in the corneal endothelial progenitors. In some embodiments, the increased expression of POU6F2 comprises an increase of at least 10,000-fold relative to endogenous expression levels of POU6F2 in the corneal endothelial progenitors.

Increasing Expression of Transcription Factors

Vectors for delivery of nucleic acids encoding the transcription factor(s) of the invention may be constructed to express the transcription factor(s) in the cells of the disclosure, e.g., corneal endothelial progenitors, neural crest stem cells or a pluripotent stem cell, e.g., an embryonic stem cell or an induced pluripotent stem cell. In some embodiments, the nucleic acid is DNA. In some embodiments, the nucleic acid is RNA. In some embodiments, the nucleic acid is modified DNA. In some embodiments, the nucleic acid is modified RNA.

In addition, protein transduction compositions or methods may also be used to effect expression of the transcription factor(s) in the methods of the invention.

A. Nucleic Acid Delivery Systems

One of skill in the art would be well equipped to construct a vector through standard recombinant techniques (see, for example, Sambrook et al., 2001 and Ausubel et al., 1996, each of which is incorporated in its entirety herein by reference). Vectors comprising a nucleic acid encoding the at least one transcription factor of the disclosure include, but are not limited to, viral vectors, non-viral vectors and/or inducible expression vectors.

As used herein, "nucleic acid" refers to deoxyribonucleotides, ribonucleotides, or modified nucleotides, and polymers thereof in single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which, in certain cases, are metabolized in a manner similar to the reference nucleotides. Examples of such analogs include, without limitation, phosphorothioates, phosphoramidates, methylphosphonates, chiral-methyl phosphonates, 2-O-methyl ribonucleotides, peptide-nucleic acids (PNAs).

As used herein, "nucleotide" is used as recognized in the art to include those with natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see, e.g., Usman and McSwiggen, supra; Eckstein, et al., International PCT Publication No. WO 92/07065; Usman et al, International PCT Publication No. WO 93/15187; Uhlman & Peyman, supra, all are hereby incorporated by reference herein). There are several examples of modified nucleic acid bases known in the art as summarized by Limbach, et al, Nucleic Acids Res. 22:2183, 1994. Some of the non-limiting examples of base modifications that can be introduced into nucleic acid molecules include, hypoxanthine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin, et al., Biochemistry 35:14090, 1996; Uhlman & Peyman, supra). By "modified bases" in this aspect is meant nucleotide bases other than adenine, guanine, cytosine and uracil at 1' position or their equivalents.

Vectors can also comprise other components or functionalities that further modulate gene delivery and/or gene expression, or that otherwise provide beneficial properties to the targeted cells. Such other components include, for example, components that influence binding or targeting to cells (including components that mediate cell-type or tissue-specific binding); components that influence uptake of the vector nucleic acid by the cell; components that influence localization of the polynucleotide within the cell after uptake (such as agents mediating nuclear localization); and components that influence expression of the polynucleotide.

Such components also might include markers, such as detectable and/or selection markers that can be used to detect or select for cells that have taken up and are expressing the nucleic acid delivered by the vector. Such components can be provided as a natural feature of the vector (such as the use of certain viral vectors which have components or functionalities mediating binding and uptake), or vectors can be modified to provide such functionalities. A large variety of such vectors are known in the art and are generally available. When a vector is maintained in a host cell, the vector can either be stably replicated by the cells during mitosis as an autonomous structure, incorporated within the genome of the host cell, or maintained in the host cell's nucleus or cytoplasm.

One of skill in the art would be well equipped to construct a vector through standard recombinant techniques (see, for example, Maniatis et al., 1988 and Ausubel et al., 1994; each of which is incorporated in its entirety herein by reference).

1. Viral Vectors

Viral vectors encoding at least one transcription factor of the invention may be provided in certain aspects of the present disclosure. A viral vector is a kind of an expression construct that utilizes viral sequences to introduce nucleic acid and possibly proteins into a cell. Non-limiting examples of viral vectors that may be used to deliver a nucleic acid of certain aspects of the present invention are described below.

In some embodiments, the viral vector is a non-integrating viral vector. An exemplary non-integrating viral vector of the disclosure is selected from the group consisting of an adeno-associated virus (AAV) vector, e.g., AAV1, AAV2, AAV3, AAV4, AAV5, AAV6, AAV7, AAV8, AAV9, AAV10, AAV3B, AAV-2i8, RhlO, Rh74 etc.; an adenovirus (Ad) vector, including replication competent, replication deficient and gutless forms thereof, e.g., Ad7, Ad4, Ad2, Ad5 etc.; a simian virus 40 (SV-40) vector, a bovine papilloma virus vector, an Epstein-Barr virus vector, a herpes virus vector, a vaccinia virus vector, a Harvey murine sarcoma virus vector, a murine mammary tumor virus vector, or a Rous sarcoma virus vector.

In some embodiments, the viral vector is an integrating viral vector, e.g., a retroviral vector. Retroviruses have promise as gene delivery vectors due to their ability to integrate their genes into the host genome, transferring a large amount of foreign genetic material, infecting a broad spectrum of species and cell types and of being packaged in special cell lines.

In some embodiments, integrating viral vectors are derived from retroviral vectors (e.g., Moloney murine leukemia virus vectors (MoMLV), MSCV, SFFV, MPSV, SNV, etc.), lentiviral vectors (e.g. derived from HIV-1, HIV-2, SIV, BIV, FIV etc.), or vectors derived therefrom.

Recombinant vectors are also capable of infecting non-dividing cells, and can be used in the methods of the invention for both in vivo and ex vivo gene transfer and expression of nucleic acid sequences. For example, recombinant lentiviruses capable of infecting a non-dividing cell, wherein a suitable host cell (i.e., the virus producing cell, and not a corneal endothelial progenitor or CEC of the disclosure), is transfected with two or more vectors carrying the packaging functions, namely gag, pol and env, as well as rev and tat is described in U.S. Pat. No. 5,994,136, incorporated in its entirety herein by reference.

2. Episomal Vectors and Other Non-Viral Vectors

The use of plasmid- or liposome-based extra-chromosomal (i.e., episomal) vectors may be also provided in certain aspects of the invention. Such episomal vectors may include, e.g., oriP-based vectors, and/or vectors encoding a derivative of EBNA-1. These vectors may permit large fragments of DNA to be introduced to a cell and maintained extra-chromosomally, replicated once per cell cycle, partitioned to daughter cells efficiently, and elicit substantially no immune response.

Other extra-chromosomal vectors include other lymphotrophic herpes virus-based vectors. Exemplary lymphotrophic herpes viruses include, but are not limited to EBV, Kaposi's sarcoma herpes virus (KSHV); Herpes virus saimiri (HS) and Marek's disease virus (MDV). Also other sources of episome-base vectors are contemplated, such as yeast ARS, adenovirus, SV40, or BPV.

In some embodiments, the vector is a non-viral vector. In some embodiments, the non-viral vector is selected from the group consisting of a plasmid DNA, a linear double-stranded DNA (dsDNA), a linear single-stranded DNA (ssDNA), a nanoplasmid, a minicircle DNA, a single-stranded oligodeoxynucleotides (ssODN), a DDNA oligonucleotide, a single-stranded mRNA (ssRNA), and a double-stranded mRNA (dsRNA).

In some embodiments, the non-viral vector comprises a naked nucleic acid, a liposome, a dendrimer, a nanoparticle, a lipid-polymer system, a solid lipid nanoparticle, and/or a liposome protamine/DNA lipoplex (LPD).

In some embodiments, the non-viral vector comprises an mRNA. In some embodiments, the mRNA may be delivered as naked modified mRNA, for example, in a sucrose-citrate buffer or saline solution. In other embodiments, a non-viral vector comprises an mRNA complexed with a transfection reagent, such as Lipofectamine 2000, jetPEI, RNAiMAX, and/or Invivofectamine. To protect mRNA against degradation by nucleases and shield its negative charge, amine-containing materials are also commonly used as non-viral vectors. One of the most developed methods for mRNA delivery is co-formulation into lipid nanoparticles (LNPs). LNP formulations are typically composed of (1) an ionizable or cationic lipid or polymeric material, bearing tertiary or quaternary amines to encapsulate the polyanionic mRNA; (2) a zwitterionic lipid (e.g., 1,2-dioleoyl-sn-glycero-3-phosphoethanolamine [DOPE]) that resembles the lipids in the cell membrane; (3) cholesterol to stabilize the lipid bilayer of the LNP; and (4) a polyethylene glycol (PEG)-lipid to lend the nanoparticle a hydrating layer, improve colloidal stability, and reduce protein absorption. Exemplary non-viral vectors comprising an mRNA are described in Kowalksi et al., 2019, *Mol Ther.;* 27(4): 710-728; incorporated in its entirety herein by reference.

3. Transposon-Based System

According to a particular embodiment the introduction of nucleic acids may use a transposon-transposase system. The used transposon-transposase system could be the well-known Sleeping Beauty, the Frog Prince transposon-transposase system (for the description of the latter see e.g. EP1507865), or the TTAA-specific transposon piggyBac system.

Transposons are sequences of DNA that can move around to different positions within the genome of a single cell, a process called transposition. In the process, they can cause mutations and change the amount of DNA in the genome. There are a variety of mobile genetic elements, and they can be grouped based on their mechanism of transposition. Class I mobile genetic elements, or retrotransposons, copy themselves by first being transcribed to RNA, then reverse transcribed back to DNA by reverse transcriptase, and then being inserted at another position in the genome. Class II mobile genetic elements move directly from one position to another using a transposase to "cut and paste" them within the genome.

4. Homologous Recombination

Homologous recombination (HR) is a targeted genome modification technique that has been the standard method for genome engineering in mammalian cells since the mid 1980s. The use of meganucleases, or homing endonucleases, such as I-SceI have been used to increase the efficiency of HR. Both natural meganucleases as well as engineered meganucleases with modified targeting specificities have been utilized to increase HR efficiency. Another path toward increasing the efficiency of HR has been to engineer chimeric endonucleases with programmable DNA specificity domains. Zinc-finger nucleases (ZFN) are one example of such a chimeric molecule in which Zinc-finger DNA binding domains are fused with the catalytic domain of a Type IIS restriction endonuclease such as FokI. Another class of such specificity molecules includes Transcription Activator Like Effector (TALE) DNA binding domains fused to the catalytic domain of a Type IIS restriction endonuclease such as FokI. Another class of such molecules that facilitate targeted genome modification include the CRISPR/Cas system, for example, as described in Ran et al., 2013*; Nature Protocols* 8:2281-2308; which is incorporated in its entirety herein by reference.

B. Regulatory Elements

Eukaryotic expression cassettes included in the vectors preferably contain (in a 5'-to-3' direction) a eukaryotic transcriptional promoter operably linked to a protein-coding sequence, splice signals including intervening sequences, and a transcriptional termination/polyadenylation sequence.

1. Promoter/Enhancers

A "promoter" is a control sequence that is a region of a nucleic acid sequence at which initiation and rate of transcription are controlled. It may contain genetic elements at which regulatory proteins and molecules may bind, such as RNA polymerase and other transcription factors, to initiate the specific transcription a nucleic acid sequence. The phrases "operatively positioned," "operatively linked," "operably linked," "under control," and "under transcriptional control" mean that a promoter is in a correct functional location and/or orientation in relation to a nucleic acid sequence to control transcriptional initiation and/or expression of that sequence.

A promoter generally comprises a sequence that functions to position the start site for RNA synthesis. Additional promoter elements regulate the frequency of transcriptional initiation. Typically, these are located in the region 30-110 bp upstream of the start site, although a number of promoters have been shown to contain functional elements downstream of the start site as well. To bring a coding sequence "under the control of" a promoter, one positions the 5' end of the transcription initiation site of the transcriptional reading frame "downstream" of (i.e., 3' of) the chosen promoter. The "upstream" promoter stimulates transcription of the DNA and promotes expression of the encoded RNA.

The spacing between promoter elements frequently is flexible, so that promoter function is preserved when elements are inverted or moved relative to one another. In the tk promoter, the spacing between promoter elements can be increased to 50 bp apart before activity begins to decline. Depending on the promoter, it appears that individual elements can function either cooperatively or independently to activate transcription. A promoter may or may not be used in conjunction with an "enhancer," which refers to a cis-acting regulatory sequence involved in the transcriptional activation of a nucleic acid sequence.

In addition to producing nucleic acid sequences of promoters and enhancers synthetically, sequences may be produced using recombinant cloning and/or nucleic acid amplification technology, including PCR™, in connection with the compositions disclosed herein (see U.S. Pat. Nos. 4,683,202 and 5,928,906, each of which is incorporated herein by reference in its entirety). Furthermore, it is contemplated the control sequences that direct transcription and/or expression of sequences within non-nuclear organelles such as mitochondria, chloroplasts, and the like, can be employed as well.

The promoters employed may be constitutive, tissue-specific, inducible, and/or useful under the appropriate conditions to direct high level expression of the introduced DNA segment, such as is advantageous in the large-scale production of recombinant proteins and/or peptides. The promoter may be artificial or endogenous.

In some embodiments, the promoter is an inducible promoter. The term "inducible promoter" is known in the art and refers to promoters that are active only in response to a stimulus. Inducible promoters selectively express a nucleic acid molecule in response to the presence of an endogenous or exogenous stimulus, for example a chemical compound (a chemical inducer) or in response to environmental, hormonal, chemical, and/or developmental signals. Inducible promoters include, for example, promoters induced or regulated by light, heat, stress, (e.g., salt stress, or osmotic stress), phytohormones, wounding, or chemicals such as ethanol, abscisic acid (ABA), jasmonate, salicylic acid, or safeners. In some embodiments, the inducible promoter is an EF1a promoter. In some embodiments, the inducible promoter is a PGK promoter.

In some embodiments, the heterologous nucleic acid is under the control of a promoter sequence selected from the group consisting of a cytomegalovirus (CMV) immediate early promoter, an RSV LTR, a MoMLV LTR, a phosphoglycerate kinase-1 (PGK) promoter, a simian virus 40 (SV40) promoter, a CK6 promoter, a transthyretin promoter (TTR), a TK promoter, a tetracycline responsive promoter (TRE), an HBV promoter, an hAAT promoter, a LSP promoter, a chimeric liver-specific promoter (LSP), an E2F promoter, a telomerase (hTERT) promoter; a cytomegalovirus enhancer/chicken beta-actin/Rabbit .beta.-globin promoter (CAG) promoter, an elongation factor 1-alpha promoter (EF1-alpha) promoter, a human .beta.-glucuronidase promoter, a chicken .beta.-actin (CBA) promoter, a retroviral Rous sarcoma virus (RSV) LTR promoter, a dihydrofolate reductase promoter, and a β-actin promoter. In some embodiments, the heterologous nucleic acid is operably linked to a promoter suitable for expression of the therapeutic polypeptide or therapeutic nucleic acid in one or more cells of the CNS.

In another embodiment, the native promoter, or fragment thereof, for the transcription factor will be used. The native promoter can be used when it is desired that expression of the transcription factor should mimic the native expression. The native promoter may be used when expression of the transcription factor must be regulated temporally or developmentally, or in a tissue-specific manner, or in response to specific transcriptional stimuli. In a further embodiment, other native expression control elements, such as enhancer elements, polyadenylation sites or Kozak consensus sequences may also be used to mimic the native expression.

Inducible promoters allow regulation of gene expression and can be regulated by exogenously supplied compounds, environmental factors such as temperature, or the presence of a specific physiological state, e.g., acute phase, a particular differentiation state of the cell, or in replicating cells only. Inducible promoters and inducible systems are available from a variety of commercial sources, including, without limitation, Invitrogen, Clontech and Ariad. Many other systems have been described and can be readily selected by one of skill in the art. Examples of inducible promoters regulated by exogenously supplied promoters include the zinc-inducible sheep metallothionine (MT) promoter, the dexamethasone (Dex)-inducible mouse mammary tumor virus (MMTV) promoter, the T7 polymerase promoter system (WO 98/10088); the ecdysone insect promoter (No et al., Proc. Natl. Acad. Sci. USA, 93:3346-3351 (1996)), the tetracycline-repressible system (Gossen et al., Proc. Natl. Acad. Sci. USA, 89:5547-5551 (1992)), the tetracycline-inducible system (Gossen et al., Science, 268:1766-1769 (1995), see also Harvey et al., Curr. Opin. Chem. Biol., 2:512-518 (1998)), the RU486-inducible system (Wang et al., Nat. Biotech., 15:239-243 (1997) and Wang et al., Gene Ther., 4:432-441 (1997)) and the rapamycin-inducible system (Magari et al., J. Clin. Invest., 100:2865-2872 (1997)). Still other types of inducible promoters which may be useful in this context are those which are regulated by a specific physiological state, e.g., temperature, acute phase, a particular differentiation state of the cell, or in replicating cells only.

In some embodiments, the heterologous nucleic acid is under the control of a promoter sequence that is expressed in one or more cells of the CEC lineage. A CEC specific promoter may include a promoter for any of the following genes: ATP6V1G1 (ATPase H+ transporting V1 subunit G1, C4orf49 (MGARP) (mitochondria localized glutamic acid rich protein), CA12 (carbonic anhydrase 12), COL4A3 (collagen type IV alpha 3 chain), COL8A1 (collagen type VIII alpha 1 chain), COL8A2 (collagen type VIII alpha 2 protein), DNAC6 (DNAJ heat shock protein family (HSP40) member C6), ENO1 (enolase 1), ENO1P1 (enolase 1 pseudogene 1), ENST00000354541, ENST00000357401, ERG (ETS transcription factor), FGF10 (fibroblast growth factor 10), FGF7 (fibroblast growth factor 7), IGFBP2 (insulin-like growth factor binding protein 2), ITGBL1 (integrin subunit beta like 1), LMX1B (LIM homeobox transcription factor 1 beta), MIR184 (MicroRNA 184), MSMP (Microseminoprotein, prostate associated), PITX2 (Paired like homeodomain 2), POU6F2 (POU class 6 homeobox 2), PTGDS (Prostaglandin D2 synthase), SHC4 (SHC adaptor protein 4), SLC4A11 (Solute carrier family 4 member 11), SLC4A4 (Solute carrier family 4 member 4) and TFAP2B (Transcription factor AP-2 beta) and ZFHX4 (Zinc finger homeobox 4) (Yoshihara et al. 2017, EBio Medicine, 25(2017), p. 175-186). In some embodiments, the promoter sequence may be ubiquitously expressed in an organism, and thus may express in a cell, for example a pluripotent stem cell, a neural crest stem cell, a corneal endothelial progenitor cell or CEC, e.g., mature CEC by virtue of its delivery to the cell. In other embodiments, a promoter sequence that specifically expresses in a cell of the CEC lineage, e.g., a neural crest stem cell, a corneal endothelial progenitor or a CEC, e.g., mature CEC, may be used.

Additionally any promoter/enhancer combination (as per, for example, the Eukaryotic Promoter Data Base EPDB, through world wide web at epd.isb-sib.ch/) could also be used to drive expression. Non-limiting examples of promoters include a constitutive EF1alpha promoter; early or late viral promoters, such as, SV40 early or late promoters, cytomegalovirus (CMV) immediate early promoters, Rous Sarcoma Virus (RSV) early promoters; eukaryotic cell promoters, such as, e.g., beta actin promoter, GADPH promoter, metallothionein promoter; and concatenated response element promoters, such as cyclic AMP response element promoters (cre), serum response element promoter (sre), phorbol ester promoter (TPA) and response element promoters (tre) near a minimal TATA box.

2. Initiation Signals and Internal Ribosome Binding Sites

A specific initiation signal also may be used for efficient translation of coding sequences. These signals include the ATG initiation codon or adjacent sequences. Exogenous translational control signals, including the ATG initiation codon, may need to be provided. One of ordinary skill in the art would readily be capable of determining this and providing the necessary signals. It is well known that the initiation codon must be "in-frame" with the reading frame of the desired coding sequence to ensure translation of the entire insert. The exogenous translational control signals and initiation codons can be either natural or synthetic. The efficiency of expression may be enhanced by the inclusion of appropriate transcription enhancer elements.

In certain embodiments of the invention, the use of internal ribosome entry sites (IRES) elements are used to create multigene, or polycistronic, messages. IRES elements are able to bypass the ribosome scanning model of 5' methylated Cap dependent translation and begin translation at internal sites. IRES elements can be linked to heterologous open reading frames. Multiple open reading frames can be transcribed together, each separated by an IRES, creating polycistronic messages. By virtue of the IRES element, each open reading frame is accessible to ribosomes for efficient translation. Multiple genes can be efficiently expressed using a single promoter/enhancer to transcribe a single message (see U.S. Pat. Nos. 5,925,565 and 5,935,819; each of which is incorporated in its entirety herein by reference).

In some embodiments, self-cleaving sequences can be used to co-express genes. The term "self-cleaving sequence" as used herein refers to a sequence that links open reading frames to form a single cistron, and induces ribosomal skipping during translation. Ribosomal skipping causes the two coding sequences connected by the self-cleaving sequence to be translated into two separate peptides. For example, 2A self-cleaving sequences can be used to create linked- or co-expression of genes in the constructs provided in the present disclosure. Exemplary self-cleaving sequences include, but are not limited to, T2A, P2A, E2A and F2A, as described in Table 2.

TABLE 2

| Exemplary 2A Sequences | | |
|---|---|---|
| T2A | GSGEGRGSLLTCGDVEENPGP | SEQ ID NO: 182 |
| P2A | GSGATNFSLLKQAGDVEENPGP | SEQ ID NO: 183 |
| E2A | GSGQCTNYALLKLAGDVESNPGP | SEQ ID NO: 184 |
| F2A | GSGVKQTLNFDLLKLAGDVESNPGP | SEQ ID NO: 185 |

In some embodiments, T2A comprises an amino acid sequence having at least 90%, 91%, 92%, 93%, 94%, 95%, 96%, 97%, 98%, 99% or 100% identity with the amino acid sequence of SEQ ID NO: 182, or a nucleic acid encoding such amino acid sequence.

In some embodiments, P2A comprises an amino acid sequence having at least 90%, 91%, 92%, 93%, 94%, 95%, 96%, 97%, 98%, 99% or 100% identity with the amino acid sequence of SEQ ID NO: 183, or a nucleic acid encoding such amino acid sequence.

In some embodiments, E2A comprises an amino acid sequence having at least 90%, 91%, 92%, 93%, 94%, 95%, 96%, 97%, 98%, 99% or 100% identity with the amino acid sequence of SEQ ID NO: 184, or a nucleic acid encoding such amino acid sequence.

In some embodiments, F2A comprises an amino acid sequence having at least 90%, 91%, 92%, 93%, 94%, 95%, 96%, 97%, 98%, 99% or 100% identity with the amino acid sequence of SEQ ID NO: 185, or a nucleic acid encoding such amino acid sequence.

3. Origins of Replication

In order to propagate a vector in a host cell, it may contain one or more origins of replication sites (often termed "ori"), for example, a nucleic acid sequence corresponding to oriP of EBV as described above or a genetically engineered oriP with a similar or elevated function in programming, which is a specific nucleic acid sequence at which replication is initiated. Alternatively a replication origin of other extra-chromosomally replicating virus as described above or an autonomously replicating sequence (ARS) can be employed.

4. Selection and Screenable Markers

In certain embodiments of the invention, cells containing a nucleic acid construct of the present invention may be identified in vitro or in vivo by including a marker in the expression vector. Such markers would confer an identifiable change to the cell permitting easy identification of cells containing the expression vector. Generally, a selection marker is one that confers a property that allows for selection. A positive selection marker is one in which the presence of the marker allows for its selection, while a negative selection marker is one in which its presence prevents its selection. An example of a positive selection marker is a drug resistance marker.

Usually the inclusion of a drug selection marker aids in the cloning and identification of transformants, for example, genes that confer resistance to neomycin, puromycin, hygromycin, DHFR, GPT, zeocin and histidinol are useful selection markers. In addition to markers conferring a phenotype that allows for the discrimination of transformants based on the implementation of conditions, other types of markers including screenable markers such as GFP, whose basis is colorimetric analysis, are also contemplated.

Alternatively, screenable enzymes as negative selection markers may be utilized. In certain embodiments, the negative selection marker comprises one or more suicide genes, which upon administration of a prodrug, effects transition of a gene product to a compound which kills its host cell. Exemplary suicide genes of the disclosure include, but are not limited to, inducible caspase 9 (or caspase 3 or 7), CD20, CD52, EGFR, thymidine kinase, cytosine deaminase, HER1 and any combination thereof. Further suicide genes known in the art that may be used in the present disclosure include purine nucleoside phosphorylase (PNP), cytochrome p450 enzymes (CYP), carboxypeptidases (CP), carboxylesterase (CE), nitroreductase (NTR), guanine ribosyltransferase (XGRTP), glycosidase enzymes, and thymidine phosphorylase (TP).

One of skill in the art would also know how to employ immunologic markers, possibly in conjunction with FACS analysis. The marker used is not believed to be important, so long as it is capable of being expressed simultaneously with the nucleic acid encoding a gene product. Further examples of selection and screenable markers are well known to one of skill in the art. One feature of the present invention includes using selection and screenable markers to select for corneal endothelial cells after the transcription factors have effected a desired change in those cells.

In certain embodiments of the invention, cells containing a nucleic acid construct of the present invention may be identified in vitro or in vivo by including a marker in the expression vector. Such markers would confer an identifiable change to the cell permitting easy identification of cells containing the expression vector. Generally, a selection marker is one that confers a property that allows for selection. A positive selection marker is one in which the presence of the marker allows for its selection, while a negative selection marker is one in which its presence prevents its selection. An example of a positive selection marker is a drug resistance marker.

Usually the inclusion of a drug selection marker aids in the cloning and identification of transformants, for example, genes that confer resistance to neomycin, puromycin, hygromycin, DHFR, GPT, zeocin and histidinol are useful selection markers. In addition to markers conferring a phenotype that allows for the discrimination of transformants based on the implementation of conditions, other types of markers including screenable markers such as GFP, whose basis is colorimetric analysis, are also contemplated.

C. Nucleic Acid Delivery

In certain embodiments, increasing the expression of the at least one transcription factor in the corneal endothelial progenitors comprises contacting a cell, e.g. a corneal endothelial progenitor or a pluripotent stem cell with the at least one transcription factor. In some embodiments, the cell, e.g., a corneal endothelial progenitor or a pluripotent stem cells comprises an expression vector comprising a nucleic acid encoding the at least one transcription factor.

Introduction of a nucleic acid, such as DNA, RNA, modified DNA or modified RNA into cells of the current invention, e.g., corneal endothelial progenitors or pluripotent stem cells, may use any suitable methods for nucleic acid delivery for transformation of a cell, as described herein or as would be known to one of ordinary skill in the art. Such methods include, but are not limited to, direct delivery of DNA such as by ex vivo transfection (Wilson et al., 1989, Nabel et al, 1989; each of which is incorporated in its entirety herein by reference), by injection (U.S. Pat. Nos. 5,994,624, 5,981,274, 5,945,100, 5,780,448, 5,736,524, 5,702,932, 5,656,610, 5,589,466 and 5,580,859; each of which is incorporated in its entirety herein by reference), including microinjection (Harland and Weintraub, 1985; U.S. Pat. No. 5,789,215; each of which is incorporated in its entirety herein by reference); by electroporation (U.S. Pat. No. 5,384,253; Tur-Kaspa et al., 1986; Potter et al., 1984; each of which is incorporated in its entirety herein by reference); by calcium phosphate precipitation (Graham and Van Der Eb, 1973; Chen and Okayama, 1987; Rippe et al., 1990; each of which is incorporated in its entirety herein by reference); by using DEAE-dextran followed by polyethylene glycol; by direct sonic loading (Fechheimer et al., 1987; which is incorporated in its entirety herein by reference); by liposome mediated transfection (Nicolau and Sene, 1982; Fraley et al., 1979; Nicolau et al., 1987; Wong et al., 1980; Kaneda et al., 1989; Kato et al., 1991; each of which is incorporated in its entirety herein by reference) and receptor-mediated transfection (Wu and Wu, 1987; Wu and Wu, 1988; each of which is incorporated in its entirety herein by reference); by microprojectile bombardment (PCT Application Nos. WO 94/09699 and 95/06128; U.S. Pat. Nos. 5,610,042; 5,322,783 5,563,055, 5,550,318, 5,538,877 and 5,538,880; each of which is incorporated in its entirety herein by reference); by agitation with silicon carbide fibers (Kaeppler et al., 1990; U.S. Pat. Nos. 5,302,523 and 5,464,765; each of which is incorporated in its entirety herein by reference); by *Agrobacterium*-mediated transformation (U.S. Pat. Nos. 5,591,616 and 5,563,055; each of which is incorporated in its entirety herein by reference); by desiccation/inhibition-mediated DNA uptake (Potrykus et al., 1985; which is incorporated in its entirety herein by reference), and any combination of such methods. Through the application of techniques such as these, organelle(s), cell(s), tissue(s) or organism(s) may be stably or transiently transformed.

In a certain embodiment of the invention, a nucleic acid may be entrapped in a lipid complex such as, for example, a liposome. Liposomes are vesicular structures characterized by a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers. Also contemplated is a nucleic acid complexed with Lipofectamine (Gibco BRL) or Superfect (Qiagen). The amount of liposomes used may vary upon the nature of the liposome as well as the cell used, for example, about 5 to about 20 μg vector DNA per 1 to 10 million of cells may be contemplated.

In certain embodiments of the present invention, a nucleic acid is introduced into an organelle, a cell, a tissue or an organism via electroporation. Electroporation involves the exposure of a suspension of cells and DNA to a high-voltage electric discharge. Recipient cells can be made more susceptible to transformation by mechanical wounding. Also, the amount of vectors used may vary upon the nature of the cells used, for example, about 5 to about 20 μg vector DNA per 1 to 10 million of cells may be contemplated.

In other embodiments of the present invention, a nucleic acid is introduced to the cells using calcium phosphate precipitation.

In another embodiment, a nucleic acid is delivered into a cell using DEAE-dextran followed by polyethylene glycol.

Additional embodiments of the present invention include the introduction of a nucleic acid by direct sonic loading.

Microprojectile bombardment techniques can also be used to introduce a nucleic acid into at least one, organelle, cell, tissue or organism (U.S. Pat. Nos. 5,550,318; 5,538,880; 5,610,042; and PCT Application WO 94/09699; each of which is incorporated herein by reference). This method depends on the ability to accelerate DNA-coated microprojectiles to a high velocity allowing them to pierce cell membranes and enter cells without killing them (Klein et al., 1987; which is incorporated in its entirety herein by reference). There are a wide variety of microprojectile bombardment techniques known in the art, which are suitable for use in the methods of the invention.

D. Gene Switches

In some embodiments, the cells of the disclosure, e.g., pluripotent stem cells or corneal endothelial progenitors, are engineered to comprise a gene switch construct encoding the transcription factor(s) of the invention. Gene switch constructs provide basic building blocks for the construction of complex gene circuits that transform cells into useful cell-based machines for biomedical applications. Ligand-responsive gene switch constructs are cellular sensors that are able to process specific signals to generate gene product responses. Their involvement in complex gene circuits results in sophisticated circuit topologies that are reminiscent of electronics and that are capable of providing engineered cells with the ability to memorize events, oscillate protein production, and perform complex information-processing tasks (see, Auslander et al., 2016*; Cold Spring Harb Perspect Biol.;* 8(7): a023895; incorporated in its entirety herein by reference). Based on the gene switch construct design strategy, the cells of the disclosure, e.g., pluripotent stem cells or corneal endothelial progenitors, can be engineered to comprise a gene switch construct encoding the transcription factor of the disclosure, along with various synthetic systems to sense different ligand inputs that in turn mediate expression of the gene switch construct encoding the transcription factor of the disclosure.

1. Transcriptional Gene Switches

In some embodiments, the gene switch construct is a transcriptional gene switch construct. In some embodiments, the transcriptional gene switch construct comprises use of prokaryotic or eukaryotic regulator proteins fused to transcriptional regulator proteins, which bind to DNA operator sequences to control the expression of the gene switch construct in a ligand-responsive manner. In some embodiments, the transcriptional gene switch construct comprises use of combining prokaryotic regulator proteins with ligand- or light-induced dimerization systems (DSs) enables the signal dependent recruitment of transcriptional regulator proteins. In some embodiments, the transcriptional gene switch construct comprises use of cell-surface-located G protein-coupled receptors (GPCRs) that sense extracellular signals and trigger signal transduction via signaling pathways to control expression of the gene switch construct. In some embodiments, the transcriptional gene switch construct comprises use of an engineered diguanylate cyclase (DGCL) that synthesizes the second messenger cyclic-di-GMP in a red-light-responsive manner, triggering a downstream signaling pathway and leading to the transcriptional activation of the gene switch construct. In some embodiments, the transcriptional gene switch construct comprises use of any of the synthetic systems described in Auslander et al., 2016; incorporated in its entirety herein by reference.

2. Post-Transcriptional Gene Switches

In some embodiments, the gene switch construct is a post-transcriptional gene switch construct. In some embodiments, the post-transcriptional gene switch construct comprises use of aptazymes fused to primary microRNA (pri-miRNA) molecules, enabling the ligand-responsive control of pri-miRNA processing and posttranscriptional target gene control. In some embodiments, the post-transcriptional gene switch construct comprises use of protein responsive aptazymes integrated into messenger RNAs (mRNAs) to regulate their stability, depending on the presence or absence of the protein ligand. In some embodiments, the post-transcriptional gene switch construct comprises use of protein binding to protein-binding aptamers that are integrated into small hairpin RNAs (shRNAs) and inhibit shRNA processing and allows for protein-controlled expression of the gene switch construct. In some embodiments, the post-transcriptional gene switch construct comprises use of protein-binding aptamers integrated into the 5' untranslated regions (UTRs) of mRNAs to control translational initiation in a protein-dependent manner. In some embodiments, the post-transcriptional gene switch construct comprises use of integration of protein-binding aptamers into close proximity of splicing sites to allow protein-responsive alternative splicing regulation. In some embodiments, the post-transcriptional gene switch construct comprises use of an ATetR-binding aptamer combined with a theophylline-responsive aptamer to enable the theophylline-dependent folding of the TetR-binding aptamer. When bound to its cognate aptamer, the TetR protein loses its DNA operator binding ability and influences gene expression at the transcriptional level.

Integrases can also act as functional genetic switch controllers, activating the coding sequence or the promoter switches designed to be turned on in eukaryotic cells. Integrases show accuracy in their site recognition and recombination process, and are not cytotoxic. In some embodiments, the gene switch construct comprises use of genetic switches controlled by serine integrases, as described in Gomide et al., 2020, *Commun Biol.;* 3(1):255; incorporated in its entirety herein by reference.

E. Protein Transduction

In certain embodiments, the cells of the disclosure, e.g., corneal endothelial progenitors, may be contacted with transcription factor(s) comprising polypeptides at a sufficient amount for generating mature corneal endothelial cells. Protein transduction has been used as a method for enhancing the delivery of macromolecules into cells. Protein transduction domains may be used to introduce transcription factor polypeptides or functional fragments thereof directly into cells.

A "protein transduction domain" or "PTD" is an amino acid sequence that can cross a biological membrane, particularly a cell membrane. When attached to a heterologous polypeptide, a PTD can enhance the translocation of the heterologous polypeptide across a biological membrane. The PTD is typically covalently attached (e.g., by a peptide bond) to the heterologous DNA binding domain. For example, the PTD and the heterologous DNA binding domain can be encoded by a single nucleic acid, e.g., in a common open reading frame or in one or more exons of a common gene. An exemplary PTD can include between 10-30 amino acids and may form an amphipathic helix. Many PTD's are basic in character. For example, a basic PTD can include at least 4, 5, 6 or 8 basic residues (e.g., arginine or lysine). A PTD may be able to enhance the translocation of a polypeptide into a cell that lacks a cell wall or a cell from a particular species, e.g., a mammalian cell, such as a human, simian, murine, bovine, equine, feline, or ovine cell.

A PTD can be linked to an artificial transcription factor, for example, using a flexible linker. Flexible linkers can include one or more glycine residues to allow for free rotation. For example, the PTD can be spaced from a DNA binding domain of the transcription factor by at least 10, 20, or 50 amino acids. A PTD can be located N- or C-terminal relative to a DNA binding domain. Being located N- or C-terminal to a particular domain does not require being adjacent to that particular domain. For example, a PTD N-terminal to a DNA binding domain can be separated from the DNA binding domain by a spacer and/or other types of domains. A PTD can be chemically synthesized then conjugated chemically to separately prepared DNA binding domain with or without linker peptide. An artificial transcription factor can also include a plurality of PTD's, e.g., a plurality of different PTD's or at least two copies of one PTD.

Several proteins and small peptides have the ability to transduce or travel through biological membranes independent of classical receptor- or endocytosis-mediated pathways. Examples of these proteins include the HIV-1 TAT protein, the herpes simplex virus 1 (HSV-1) DNA-binding protein VP22, and the *Drosophila* Antennapedia (Antp) homeotic transcription factor. The small protein transduction domains (PTDs) from these proteins can be fused to other macromolecules, peptides or proteins to successfully transport them into a cell. Sequence alignments of the transduction domains from these proteins show a high basic amino acid content (Lys and Arg) which may facilitate interaction of these regions with negatively charged lipids in the membrane. Secondary structure analyses show no consistent structure between all three domains.

The advantages of using fusions of these transduction domains is that protein entry is rapid, concentration-dependent and appears to work with difficult cell types. PTDs are further described in U.S. 2003/0082561; U.S. 2002/0102265; U.S. 2003/0040038; each of which is incorporated in its entirety herein by reference.

In addition to PTDs, cellular uptake signals can be used. Such signals include amino acid sequences which are specifically recognized by cellular receptors or other surface proteins. Interaction between the cellular uptake signal and the cell cause internalization of the artificial transcription factor that includes the cellular uptake signal. Some PTDs may also function by interaction with cellular receptors or other surface proteins.

Cell Culturing

Generally, cells of the present invention are cultured in a culture medium, which is a nutrient-rich buffered solution capable of sustaining cell growth.

CEC of the invention can be made by culturing pluripotent stem cells or other cells, e.g., corneal endothelial progenitors or neural crest stem cells in a medium under conditions that increase the intracellular level of transcription factors described herein to be sufficient to promote generation of CEC, e.g., mature CEC. The medium may also contain one or more CEC differentiation agents, like various kinds of growth factors. These agents may either help induce cells to commit to a more mature phenotype—or preferentially promote survival of the mature cells—or have a combination of both these effects.

CEC differentiation agents illustrated in this disclosure may include soluble growth factors (peptide hormones, cytokines, ligand-receptor complexes, and other compounds such as chondroitin sulfate A, pituitary extract and ascorbic acid) that are capable of promoting the growth of cells of the CEC lineage. Non-limiting examples of such agents include but are not limited to Noggin, SB431542, basic fibroblast growth factor (FGF), epidermal growth factor (EGF), Rock Inhibitor, and nerve growth factor (NGF). Additional factors may include Leukemia inhibitory factor (LIF), GSK3 inhibitor, retinoic acid, gamma secretase inhibitor, BMP inhibitors of TGFβ/Activin/Nodal including dorsomorphin, chordin and follistatin, IL-1, insulin, TGF-α, TGF-β, heparin, insulin-like growth factors I and II (IGF-I, IGF-2), platelet derived growth factor B (PDGFB) and PDGFB agonists, DKK2 and DKK2 agonists, angiopoietin-like protein 7 (ANGPL7), B27 supplement and glucagon.

Pluripotent cells or other cells, e.g., corneal endothelial progenitors or neural crest stem cells may be differentiated in the presence of Noggin (e.g., human Noggin polypeptide, such as NP_005441.1 or the mature polypeptide contained therein) and/or SB431542 or derivatives (collectively, "dual SMAD inhibitors"). Pluripotent cells or other cells, e.g., corneal progenitor cells or neural crest cells may be differentiated in the presence of naturally secreted BMP inhibitors chordin and follistatin, as well as analogs or mimetics thereof, dominant negative receptors or blocking antibodies that would sequester BMP2, BMP4, and/or BMP7 and/or dorsomorphin (or Compound C). Inhibition of SMAD proteins may also be effected using soluble inhibitors such as SIS3 (6,7-Dimethoxy-2-((2E)-3-(1-methyl-2-phenyl-1H-pyrrolo[2,3-b]pyridin-3-yl-1-prop-2-enoyl))-1,2,3,4-tetrahydroisoquinoline, Specific Inhibitor of Smad3, SIS3, overexpression of one or more of the inhibitor SMADs (e.g., SMAD6, SMAD7, SMAD10) or RNAi for one of the receptor SMADs (SMAD1, SMAD2, SMAD3, SMAD5, SMAD8/9). Other agents for differentiation of pluripotent cells or other cells, e.g., corneal progenitor cells or neural crest stem cells, may be Leukemia Inhibitory Factor (LIF), GSK3 inhibitor (CHIR 99021), Compound E (γ secretase inhibitor XXI) and/or the TGFβ inhibitor SB431542 (Li et al., Proc Natl Acad Sci USA. 2011 May 17; 108(20):8299-304).

Pluripotent stem cells undergoing corneal progenitor cell or neural crest induction, may be cultured in the presence of SB431542, which may be present in the culture media in a concentration as low as 10 nM, 20 nM, 50 nM, 0.1 μM, or lower, or as high as 20 μM, 50 μM, 100 μM, or higher, such as 10 nM to 100 μM, 0.1 μM to 50 μM, 0.1-20 μM, or 1-20 μM, or about 10 μM.

Pluripotent cells, such as pluripotent cells undergoing corneal progenitor cell or neural crest induction, may be cultured in the presence of Noggin, which may be present in the culture media in a concentration as low as 10 ng/ml, 20 ng/ml, 50 ng/ml, 100 ng/ml, or lower, or as high as 700 ng/ml, 1000 ng/ml, 1500 ng/ml, 2000 ng/ml, 3000 ng/ml, 4000 ng/ml, 5000 ng/ml, or higher, such as 10 ng/ml to 5,000 ng/ml, 100 ng/ml to 700 ng/ml, or 400 ng/ml to 600 ng/ml, preferably about 500 ng/ml. Pluripotent cells may also be cultured with combinations of SB431542 and Noggin, e.g., combinations of the foregoing concentrations.

Basic FGF may be present in cultures of pluripotent cells, e.g., during corneal progenitor cell or neural crest induction, which may be present in the culture media in a concentration as low as 1 ng/ml, 2 ng/ml, 3 ng/ml, 4 ng/ml, 5 ng/ml, 6 ng/ml, or lower, or up to 10 ng/ml, 20 ng/ml, 50 ng/ml, 100 ng/ml, 500 ng/ml, or 1 μg/ml, such as 1 ng/ml-1 μg/ml, 1 ng/ml-100 ng/ml, 2 ng/ml-10 ng/ml, 6 ng/ml-100 ng/ml, or about 6 ng/ml.

Basic FGF may be present in cultures of corneal progenitor cells, neural crest stem cells or CEC, e.g., during CEC differentiation from corneal progenitor cells or neural crest stem cells or in cultures comprising CEC, which may be present in the culture media in a concentration as low as 0.1 ng/ml, 0.2 ng/ml, 0.5 ng/ml, 1 ng/ml, 2 ng/ml, 3 ng/ml, 4 ng/ml, 5 ng/ml, 6 ng/ml, or lower, or up to 10 ng/ml, 20 ng/ml, 50 ng/ml, 100 ng/ml, 500 ng/ml, or 1 g/ml, such as 0.1 ng/ml-1 μg/ml, 0.1 ng/ml-400 ng/ml, 0.1 ng/ml-100 ng/ml, 0.1 ng/ml-10 ng/ml, 1 ng/ml-100 ng/ml, or about 6 ng/ml.

EGF may be present in cultures of corneal progenitor cells, neural crest stem cells or CEC, e.g., during CEC differentiation from corneal progenitor cells or neural crest stem cells or in cultures comprising CEC, which may be present in the culture media in a concentration as low as 0.1 ng/ml, 0.2 ng/ml, 0.5 ng/ml, 1 ng/ml, 2 ng/ml, 3 ng/ml, 4 ng/ml, 5 ng/ml, 6 ng/ml, or lower, or up to 10 ng/ml, 20 ng/ml, 50 ng/ml, 100 ng/ml, 500 ng/ml, or 1 μg/ml, such as 0.1 ng/ml-1 μg/ml, 0.1 ng/ml-400 ng/ml, 0.1 ng/ml-100 ng/ml, 0.1 ng/ml-10 ng/ml, 1 ng/ml-100 ng/ml, or about 5 ng/ml.

NGF may be present in cultures of corneal progenitor cells, neural crest stem cells or CEC, e.g., during CEC differentiation from corneal progenitor cells or neural crest stem cells or in cultures comprising CEC, which may be present in the culture media in a concentration as low as 0.1 ng/ml, 0.2 ng/ml, 0.5 ng/ml, 1 ng/ml, 2 ng/ml, 3 ng/ml, 4 ng/ml, 5 ng/ml, 6 ng/ml, or lower, or up to 10 ng/ml, 20 ng/ml, 50 ng/ml, 100 ng/ml, 500 ng/ml, or 1 μg/ml, such as 0.1 ng/ml-1 μg/ml, 0.1 ng/ml-400 ng/ml, 0.1 ng/ml-100 ng/ml, 0.1 ng/ml-10 ng/ml, 1 ng/ml-100 ng/ml, or about 20 ng/ml.

ROCK inhibitors may be present in cultures of pluripotent stem cells, or during the during CEC differentiation. "ROCK inhibitors" refer to any substance that inhibits or reduces the function of Rho-associated kinase or its signaling pathway in a cell, such as a small molecule, an siRNA, a miRNA, an antisense RNA, or the like. "ROCK signaling pathway," as used herein, may include any signal processors involved in the ROCK-related signaling pathway, such as the Rho-ROCK-Myosin II signaling pathway, its upstream signaling pathway, or its downstream signaling pathway in a cell. An exemplary ROCK inhibitor that may be used is Stemgent's Stemolecule Y-27632, a rho-associated protein kinase (ROCK) inhibitor (see Watanabe et al., Nat Biotechnol. 2007 June; 25(6):681-6) Other ROCK inhibitors include, e.g., H-1152, Y-30141, Wf-536, HA-1077, hydroxyl-HA-1077, GSK269962A and SB-772077-B. Doe et al., J. Pharmacol. Exp. Ther., 32:89-98, 2007; Ishizaki, et al., Mol. Pharmacol., 57:976-983, 2000; Nakajima et al., Cancer Chemother. Pharmacol., 52:319-324, 2003; and Sasaki et al., Pharmacol. Ther., 93:225-232, 2002, each of which is incorporated herein by reference as if set forth in its entirety. ROCK inhibitors may be utilized with concentrations and/or culture conditions as known in the art, for example as described in US PGPub No. 2012/0276063 which is hereby incorporated by reference in its entirety. Additional examples of the Rho-associated kinase inhibitors include compounds disclosed in the following references: U.S. Pat. Nos. 4,678,783, 3,421,217, WO99/20620, WO99/61403, WO02076976, WO02/076977, WO02/100833, WO03/059913, WO03/062227, WO2004/009555, WO2004/022541, WO2004/108724, WO2005/003101, WO2005/039564, WO2005/034866, WO2005/037197, WO2005/037198, WO2005/035501, WO2005/035503, WO2005/035506, WO2005/080394, WO2005/103050, WO2006/057270, WO2007/026664 and the like. Such compounds can be produced according to the method described in each of the respective references. Specific examples include 1-(5-isoquinolinesulfonyl)homopiperazine (fasudil), (+)-trans-4-(1-aminoethyl)-1-(4-pyridylcarbamoyl)cyclohexane (Y-27632) and the like, as well as salts thereof, preferably pharmaceutically acceptable salts such as hydrochloride salts. In exemplary embodiments, the ROCK inhibitor may have a concentration of about 0.05 to about 50 microM, for example, at least or about 0.05, 0.1, 0.2, 0.5, 0.8, 1, 1.5, 2, 2.5, 5, 7.5, 10, 15, 20, 25, 30, 35, 40, 45, or 50 microM, including any range derivable therein, or any concentration effective for promoting cell growth or survival.

Corneal endothelial progenitors or neural crest stem cells may be cultured in the presence of PDGFB (e.g., human PDGFB polypeptide, such as NP_002599.1 or the mature polypeptide contained therein), and culture media comprising PDGFB, and/or PDGFAA or PDGFAB, Phorbol 12-myristate 13-acetate (PMA) or vascular endothelial growth factor (VEGF). Cultures comprising corneal endothelial progenitors or neural crest stem cells, such as in a culture comprising pluripotent cells after commencing neural crest induction or during neural crest induction, or corneal endothelial progenitors may be cultured in the presence of PDGFB which may be present in the culture media in a concentration as low as 0.1 ng/ml, 0.2 ng/ml, 0.5 ng/ml, 1 ng/ml, or lower, or as high as 10 ng/ml, 20 ng/ml, 30 ng/ml, 50 ng/ml, 75 ng/ml, 100 ng/ml, 125 ng/ml, 150 ng/ml, 200 ng/ml, 250 ng/ml, or higher, such as 0.1 ng/ml to 250 ng/ml, 0.5 ng/ml to 150 ng/ml, 1-50 ng/ml, 2-20 ng/ml, preferably about 10 ng/ml.

Pluripotent cells or other cells, e.g., corneal progenitor cells or neural crest cells may be cultured in the presence of DKK2 (e.g., human DKK2 polypeptide, such as NP_055236.1 or the mature polypeptide contained therein), and culture media comprising DKK2. Neural crest stem cells (whether obtained from differentiating pluripotent cells or other sources) and/or differentiating pluripotent cells cultured under conditions expected to produce neural crest stem cells (e.g., culture in the presence of dual SMAD inhibitors) or corneal endothelial progenitors may be cultured in the presence of DKK2 or a DKK2 agonist. A DKK2 agonist may include any Wnt pathway activators and/or inhibitors that may functionally replace DKK2 in the differentiation of CEC. RNAi that targets and knocks down the expression of LRP5/6 or Kremen, may be used in addition to or instead of DKK2. Wnt pathway inhibitors such as DKK 1, 3, 4 and Soggy, secreted frizzled related proteins (Frzb), and Wnt inhibitor factor (WIF) or Casein Kinase 1-7 or other factors that stabilize or destabilize β-catenin, may also be used in addition to or instead of DKK2. Additionally, modulating the LEF/TCF transcription factor members may be used in addition to or instead of DKK2. Exemplary Wnt pathway activators include Wnt proteins, nucleic acids encoding Wnt proteins, LiCl, inhibitors of negative regulators of Wnt pathway (e.g., RNAi or other inhibitors targeting Axin and/or APC), norrin, R-spondin2. Small molecule Wnt pathway activators include: (hetero)arylpyrimidines, IQ1, BIO(6-bromoindirubin-3'-oxime), 2-amino-4-[3,4-(methylenedioxy)benzyl-amino]-6-(3-methoxyphenyl)pyrimidin-e, WAY-316606, QS11, SB-216763, SB-216763, and DCA. Small molecule Wnt pathway inhibitors include: IWR, pyrvinium, ICG-001, PKF115-584 (and several other compounds), IWP, Ant1.4Br/Ant 1.4C1, Niclosamide, apicularen and bafilomycin, XAV939, NSC668036, 2,4-diamino-quinazoline, and Quercetin. Additional exemplary WNT pathway inhibitors which may be utilized include ID8 (Hasagawa et al., Stem Cells Transl Med. 2012 January; 1(1):18-28), Wnt C59 (Proffitt Cancer Res Published OnlineFirst Nov. 27, 2012; DOI:10.1158/0008-5472.CAN-12-2258), CGK062 (Gwak et al., PLoS ONE. 2012; 7(10): e46697), IWP2 (Blauwkamp et al., Nat Commun. 2012; 3:1070), FH535 (Iida et al., PLoS One. 2012; 7(9):e44418), and Riluzole (Zhao et al., J Biomol Screen. 2012 October; 17(9):1252-63). Combinations of the foregoing factors may also be used in addition to or instead of DKK2, e.g., combinations comprising more than one Wnt pathway activator, more than one Wnt pathway inhibitor, or at least one Wnt pathway activator and at least one Wnt pathway inhibitor.

Corneal progenitor cells or neural crest stem cells, such as in a culture comprising pluripotent cells after commencing neural crest induction or during neural crest induction, may be cultured in the presence of DKK2, which may be present in the culture media in a concentration as low as 1 ng/ml, 2 ng/ml, 3 ng/ml, 4 ng/ml, 5 ng/ml, 6 ng/ml, or lower, or as high as 10 ng/ml, 20 ng/ml, 50 ng/ml, 100 ng/ml, 1 μg/ml, 5 μg/ml, 10 μg/ml, 15 μg/ml, or higher, such as 1 ng/ml-15 μg/ml, 10 ng/ml-15 μg/ml, 1 ng/ml-1 μg/ml, 1 ng/ml-100 ng/ml, 2 ng/ml-20 ng/ml, or 5 ng/ml-20 ng/ml, preferably about 10 ng/ml.

Pluripotent cells or other cells, e.g., corneal progenitor cells or neural crest cells may be cultured with one or more factors that promote CEC proliferation. Such factors may be included in a culture of cells during and/or subsequent to formation of corneal endothelial cells and may include EGF, NGF and ITS supplement containing insulin and/or transferrin.

In some embodiments, the methods of the invention comprise increasing expression of at least one transcription factor selected from the group consisting of ATF4, ATMIN, BHLHE40, CEBPD, CSRNP1, DRAP1, EGR1, ELF2, EMX2, ESRRA, ETS 2, FOS, FOSB, FOSL2, GTF3A, HIF1A, JUN, JUNB, JUND, KLF10, KLF9, MBD3, NFE2L1, NME2, NR1D1, NR4A1, PA2G4, POU3F3, RELA, TBX2, TFAP2B, TFDP1, TSC22D1, USF2, YBX1, ZNF207, ZNF358, and ZNF395, in corneal endothelial progenitor cells and culturing the corneal progenitor cells in a culture media.

In some embodiments, the methods of the invention comprise increasing expression of at least one transcription factor selected from the group consisting of ATF4, ATMIN, BHLHE40, CEBPD, CSRNP1, DRAP1, EGR1, ELF2, EMX2, ESRRA, ETS2, FOS, FOSB, FOSL2, GTF3A, HIF1A, JUN, JUNB, JUND, KLF10, KLF9, MBD3, NFE2L1, NME2, NR1D1, NR4A1, PA2G4, POU3F3, RELA, TBX2, TFAP2B, TFDP1, TSC22D1, USF2, YBX1, ZNF207, ZNF358, and ZNF395, in pluripotent stem cells, e.g., induced pluripotent stem cells or embryonic stem cells and culturing the pluripotent stem cells in a culture media.

In some embodiments, the corneal progenitor cells are cultured for at least 2, 3, 4, 5, 6, 7, 8, 9, 10, 11 or 12 days or more before increasing the expression of at least one transcription factor disclosed herein. In some embodiments, the corneal progenitor cells are cultured for at least 8 days before increasing the expression of the at least one transcription factor. In some embodiments, the corneal progenitor cells are cultured for at least 10 days before increasing the expression of the at least one transcription factor. In some embodiments, the corneal progenitor cells are cultured for at least 12 days before increasing the expression of the at least one transcription factor.

In some embodiments, the corneal progenitor cells are cultured for at least 2, 4, 6, 8, 10, 12, 14, 16, 18, 20, 22 or 24 days or more after increasing the expression of at least one transcription factor disclosed herein. In some embodiments, the corneal progenitor cells are cultured for at least 2 days after increasing the expression of the at least one transcription factor. In some embodiments, corneal progenitor cells are cultured for at least 4 days, at least 10 days, at least 18 days or at least 24 days after increasing the expression of the at least one transcription factor. In some embodiments, the corneal progenitor cells are cultured for at least 18 days after increasing the expression of the at least one transcription factor.

In some embodiments, the corneal progenitor cells are derived from pluripotent stem cells. Culture media suitable for isolating, expanding and differentiating pluripotent stem cells into corneal progenitor cells according to the method described herein include but not limited to StemFit Basic03 medium (Ajinomoto), mTeSR1 media, high glucose Dulbecco's Modified Eagle's Medium (DMEM), DMEM/F-15 (Thermo Fisher #11330-032), Liebovitz L-15, RPMI 1640, Iscove's modified Dubelcco's media (IMDM) and Opti-MEM SFM (Invitrogen Inc.). Chemically Defined Medium comprises a minimum essential medium such as Iscove's Modified Dulbecco's Medium (IMDM) (Gibco), supplemented with human serum albumin, human Ex Cyte lipoprotein, transferrin, insulin, vitamins, essential and non-essential amino acids, sodium pyruvate, glutamine and a mitogen is also suitable. As used herein, a mitogen refers to an agent that stimulates cell division of a cell. An agent can be a chemical, usually some form of a protein that encourages a cell to commence cell division, triggering mitosis. In one embodiment, serum free media (U.S. application Ser. No. 08/464,599 and PCT Publication No. WO96/39487; each of which is incorporated in its entirety herein by reference) and complete media (U.S. Pat. No. 5,486,359, incorporated in its entirety herein by reference), are contemplated for use with the methods described herein. In some embodiments, the culture medium is supplemented with 10% Fetal Bovine Serum (FBS), human autologous serum, human AB serum or platelet rich plasma supplemented with heparin (2 U/ml). Cell cultures may be maintained in a $CO_2$ atmosphere, e.g., 5% to 12%, to maintain pH of the culture fluid, incubated at 37° C., in a humid atmosphere and passaged to maintain a confluence of 100% during corneal endothelial progenitor differentiation.

Pluripotent stem cells to be differentiated into corneal progenitor cells or neural crest stem cells may be cultured in a medium sufficient to maintain the pluripotency. Culturing of induced pluripotent stem (iPS) cells generated in certain aspects of this invention can use various medium and techniques developed to culture primate pluripotent stem cells, more specially, embryonic stem cells (U.S. Patent Application No. 20070238170 and U.S. Patent Application No. 20030211603; each of which is incorporated in its entirety herein by reference). For example, PSCs can be maintained in StemFit medium with or without ROCK inhibitor, or mTeSR1 medium. Like human embryonic stem (hES) cells, iPS cells can be maintained in 80% DMEM (Gibco #10829-018 or #11965-092), 20% defined fetal bovine serum (FBS) not heat inactivated, 1% non-essential amino acids, 1 mM L-glutamine, and 0.1 mM β-mercaptoethanol. Alternatively, ES cells can be maintained in serum-free medium, made with 80% Knock-Out DMEM (Gibco #10829-018), 20% serum replacement (Gibco #10828-028), 1% non-essential amino acids, 1 mM L-glutamine, and 0.1 mM β-mercaptoethanol.

In some embodiments, methods of culturing pluripotent stem cells and inducing formation of corneal progenitor cells or neural stem crest cells comprise culturing the pluripotent stem cells in a differentiation media comprising basic FGF, SB431542 and Noggin thereby generating the corneal endothelial progenitors e.g. neural crest cells.

In some embodiments, methods of culturing pluripotent stem cells include culture on a suitable matrix, for example iMatrix 511 (Takara Bio, T304).

In some embodiments, the pluripotent stem cells are cultured for at least 1, 2, 3, 4, 5, 6, 7, 8, 9, 10 or 12 days.

In some embodiments, the corneal progenitor cells are cultured for at least 2, 3, 4, 5, 6, 7, 8, 9, 10, 11 or 12 before increasing the expression of at least one transcription factor disclosed herein. In some embodiments, the corneal progenitor cells are cultured for at least 8 days before increasing the expression of the at least one transcription factor. In some embodiments, the corneal progenitor cells are cultured for at least 10 days before increasing the expression of the at least one transcription factor. In some embodiments, the corneal progenitor cells are cultured for at least 12 days before increasing the expression of the at least one transcription factor. In some embodiments, the corneal endothelial progenitors are cultured in a culture media comprising ROCK inhibitor, e.g., Y27632, human FGF-basic SB431542, Noggin, EGF and/or NGF before increasing the expression of the at least one transcription factor.

In some embodiments, the corneal progenitor cells are cultured for at least 2, 4, 6, 8, 10, 12, 14, 16, 18, 20, 22 or 24 days or more after increasing the expression of at least one transcription factor disclosed herein. In some embodiments, the corneal progenitor cells are cultured for at least 2 days after increasing the expression of the at least one transcription factor. In some embodiments, corneal progenitor cells are cultured for at least 4 days, at least 10 days, at least 18 days or at least 24 days after increasing the expression of the at least one transcription factor. In some embodiments, the corneal progenitor cells are cultured for at least 18 days after increasing the expression of the at least one transcription factor.

In some embodiments, the corneal endothelial progenitors are cultured in a culture media comprising EGF and/or NGF before or after increasing the expression of the at least one transcription factor.

In order to generate pluripotent stem cell derived corneal endothelial progenitors, in some embodiments, monolayers of pluripotent cells are harvested and plated, e.g., at a density of $2\times10^5$ cells/$cm^2$. Step 1 of the differentiation process is initiated by culturing pluripotent stem cells for at least 1, 2, 3, 4, 5, 6, 7, 8, 9 or 10 days in a culture media with or without a ROCK inhibitor for 1, 2 or 3 days or more. This is followed by Step 2, culturing the cells obtained in Step 1 in culture media with one or more of FGF-2, SB431542 and Noggin for at least 4, 6, 8 or 10 days. This is followed by Step 3, culturing the cells obtained in Step 2 in a culture media for at least 1, 2, 3, 4, or 5 days comprising EGF in the presence or absence of a ROCK inhibitor. This is followed by culturing the cells for at least 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 days in a culture media comprising one EGF and NGF.

Media useful for preparing pluripotent stem cell derived corneal endothelial progenitors include:

TABLE 3

| Maturation medium 1 | | | |
|---|---|---|---|
| Components with final concentration | Manufacturer | Catalog Number | For 500 ml |
| Opti-MEM ® I Reduced-Serum Medium | Thermo Fisher Scientific | 31985-070 | 460 ml |

TABLE 3-continued

| Maturation medium 1 | | | |
|---|---|---|---|
| Components with final concentration | Manufacturer | Catalog Number | For 500 ml |
| 8% Fetal Bovine Serum | Hyclone | SH30070.03 | 40 ml |
| 200 mg/L calcium chloride | Sigma-Aldrich | C5670-100G | 100 mg |
| 0.08% chondroitin sulfate A | Sigma-Aldrich | C9819-5G | 400 mg |
| Penicillin-Streptomycin | Thermo Fisher Scientific | 15140-122 | 5 ml |
| Bovine Pituitary Extract | Alfa Aesar | J64417 | 50 mg |
| 5 ng/ml epidermal growth factor | Sigma | E9644-.2MG | 100 ul of 5 ug/ml stock |
| 20 ug/ml ascorbic acid | Sigma | A4403-100MG | 100 ul of 20 mg/ml stock |
| 10 uM Y27632 | R&D system | 1254/10 | 100 ul of 10 mM stock |

TABLE 4

| Maturation medium 2 | | | |
|---|---|---|---|
| Components with final concentration | Manufacturer | Catalog Number | For 500 ml |
| Opti-MEM ® I Reduced-Serum Medium | ThermoFisher Scientific | 31985-070 | 460 ml |
| 8% Fetal Bovine Serum | Hyclone | SH30070.03 | 40 ml |
| 200 mg/L calcium chloride | Sigma | C5670-100G | 100 mg |
| 0.08% chondroitin sulfate A | Sigma | C9819-5G | 400 mg |
| Penicillin-Streptomycin | Thermo Fisher Scientific | 15140-122 | 5 ml |
| 5 ng/ml epidermal growth factor | Sigma | E9644-.2MG | 100 ul of 5 ug/ml stock |
| 20 ug/ml ascorbic acid | Sigma | A4403-100MG | 100 ul of 20 mg/ml stock |

TABLE 5

| Maturation medium 3 | | | |
|---|---|---|---|
| Components with final concentration | Manufacturer | Catalog Number | For 500 ml |
| Opti-MEM ® I Reduced-Serum Medium | ThermoFisher Scientific | 31985-070 | 460 ml |
| ITS supplement | Sigma | I3146 | 1 ml |
| 200 mg/L calcium chloride | Sigma | C5670-100G | 100 mg |
| 0.08% chondroitin sulfate A | Sigma | C9819-5G | 400 mg |
| Penicillin-Streptomycin | Thermo Fisher Scientific | 15140-122 | 5 ml |
| 5 ng/ml epidermal growth factor | Sigma | E9644-.2MG | 100 ul of 5 ug/ml stock |
| 20 ug/ml ascorbic acid | Sigma | A4403-100MG | 100 ul of 20 mg/ml stock |
| 20 ng/ml NGF | Peprotech | 450-01 | 100 ul of 20 ug/ml stock |

Corneal Endothelial Cell Markers

CEC, e.g., mature CEC can be characterized according to a number of phenotypic criteria. The criteria include but are not limited to the detection or quantitation of expressed cell markers, pump activity, in vivo efficacy regarding repair of the cornea and improvement of corneal function in vivo, as well as the characterization of morphological features in vitro and following engraftment in vivo.

CEC, e.g., mature CEC embodied in certain aspects of this invention have morphological features characteristic of CEC in nature, such as derived from the cornea. The features are readily appreciated by those skilled in the art, and include any or all of the following: mitochondria-rich cells that (in a living organism) line the posterior surface of the cornea and face the anterior chamber of the eye, ability to form a monolayer of uniformly sized cells with a predominantly polygonal or hexagonal shape, ability to form a "leaky pump" which allows leakage of solutes and nutrients from the aqueous humor to the more superficial layers of the cornea while at the same time actively pumping water in the opposite direction, from the stroma to the aqueous, and resistance to oxidative stress. A number of these features present in a single cell are consistent with the cell being a member of the CEC lineage.

CEC, e.g., mature CEC of the invention can also be characterized according to whether they express phenotypic markers characteristic of cells of the CEC lineage. Exemplary corneal endothelial cell markers include but are not limited to: PITX2, SLC4A11, FOXC1, COL8A1, COL8A2, TFAP2B, LMX1B, AQP1, ATP1A1, TJP1, NCAM1, CDH2, SLC4A4, CD166, POU6F2, CD248, MRGPRX3, KLF13, CA2, NBC1, N-Cadherin Na+/K+ ATPase, ZO-1, KLF13, Collagen VIII, SLC16A3, CFTR, NBC1, CA2, AE2, SCL4A2, SCL16A1, CA12 and CA4. CEC, e.g., mature CEC may not express NGFR, SOX10, HNK1, SSEA4, NANOG, OCT4, vWF and CD31 (the latter being present in vascular endothelial cells). CEC, e.g., mature CEC may express one or more corneal endothelial pump markers (which include: AQP1, CA2, CA4, CA12, SCL14A2, SLC16A1, SLC16A3, SLC16A7, CFTR, NHE1, ADCY10, voltage-dependent anion channels VDAC2 and VDAC3, chloride channel proteins CLCN2 and CLC), periocular neural crest markers (which include: PITX2, and FOXC1), and/or cell adhesion and matrix proteins (which include: Occludin, Connexin 43, 9.3E antigen, Collagen III, Collagen IV, N cadherin, VE cadherin, E cadherin, beta catenin, p120, p190 Laminin alpha 4, Nidogen-2, and Netrin 4). CEC, e.g., mature CEC may express at least one corneal endothelial pump marker, at least one periocular neural crest marker, and at least one cell adhesion and matrix protein.

CEC markers may include any one of the markers provided in Table 6 (mRNA sequences provided as SEQ ID NOs: 98-140 and amino acid sequences provided as SEQ ID NOs: 141-181).

TABLE 6

| Transcription Factor | Accession No. | SEQ ID NO: | Accession No. | SEQ ID NO: |
|---|---|---|---|---|
| SLC4A11 | NM_001174089.2 | 98 | NP_001167560.1 | 141 |
| | NM_032034.4 | 99 | NP_114423.1 | 142 |
| | NM_001174090.2 | 100 | NP_001167561.1 | 143 |
| | NM_001363745.2 | 101 | NP_001350674.1 | 144 |
| COL8A1 | NM_001850 | 102 | NP_001841.2 | 145 |
| | NM_020351.4 | 103 | NP_065084.2 | 145 |
| COL8A2 | NM_001294347.2 | 104 | NP_001281276.1 | 147 |
| | NM_005202.4 | 105 | NP_005193.1 | 148 |
| AQP1 | NM_001329872.2 | 106 | NP_001316801.1 | 149 |
| | NM_198098.4 | 107 | NP_932766.1 | 150 |
| ATP1A1 | NM_000701.8 | 108 | NP_000692.2 | 151 |
| | NM_001160233.2 | 109 | NP_001153705.1 | 152 |
| | NM_001160234.2 | 110 | NP_001153706.1 | 153 |

TABLE 6-continued

| Transcription Factor | Accession No. | SEQ ID NO: | Accession No. | SEQ ID NO: |
|---|---|---|---|---|
| TJP1 | NM_001301025.3 | 111 | NP_001287954.2 | 154 |
| | NM_001301026.2 | 112 | NP_001287955.1 | 155 |
| | NM_001330239.4 | 113 | NP_001317168.1 | 156 |
| | NM_001355012.2 | 114 | NP_001341941.1 | 157 |
| | NM_001355013.1 | 115 | NP_001341942.1 | 158 |
| | NM_001355014.2 | 116 | NP_001341943.1 | 159 |
| | NM_001355015.2 | 117 | NP_001341944.1 | 160 |
| | NM_003257.5 | 118 | NP_003248.3 | 161 |
| | NM_175610.4 | 119 | NP_783297.2 | 162 |
| NCAM1 | NM_000615.7 | 120 | NP_000606.3 | 163 |
| | NM_001076682.4 | 121 | NP_001070150.1 | 164 |
| | NM_001242607.2 | 122 | NP_001229536.1 | 165 |
| | NM_001242608.2 | 123 | NP_001229537.1 | 166 |
| | NM_001386289.1 | 124 | NP_001373218.1 | 167 |
| | NM_001386290.1 | 125 | NP_001373219.1 | 168 |
| | NM_001386291.1 | 126 | NP_001373220.1 | 169 |
| | NM_001386292.1 | 127 | NP_001373221.1 | 170 |
| | NM_181351.5 | 128 | NP_851996.2 | 171 |
| CDH2 | NM_001308176.2 | 129 | NP_001295105.1 | 172 |
| | NM_001792.5 | 130 | NP_001783.2 | 173 |
| SLC4A4 | NM_001098484.3 | 131 | NP_001091954.1 | 174 |
| | NM_001134742.2 | 132 | NP_001128214.1 | 175 |
| | NM_003759.4 | 133 | NP_003750.1 | 176 |
| CD166 | NM_001243280.2 | 134 | NP_001230209.1 | 177 |
| (ALCAM) | NM_001243281.2 | 135 | NP_001230210.1 | 178 |
| | NM_001243283.2 | 136 | NP_001230212.1 | 179 |
| | NM_001627.4 | 137 | NP_001618.2 | 180 |
| CD248 | NM_020404.3 | 138 | NP_065137.1 | 181 |
| MRGPRX3 | NM_001370464.1 | 139 | NP_001357393.1 | 146 |
| | NM_054031.4 | 140 | NP_473372.3 | 146 |

CEC, e.g., mature CEC may also display a global gene expression profile that is indicative of CEC maturation. Global gene expression profiles may be compared to those of primary CEC or known mature CEC and may be obtained by any method known in the art, for example transcriptomic analysis or microarray analysis. In some embodiments, increasing the expression of the at least one transcription factor shifts the transcriptome of corneal endothelial progenitors towards the transcriptome of CEC, e.g., mature CEC by at least 1%, 5%, 10%, 20%, 30%, 40%, or 50%. In some embodiments, increasing the expression of the at least one transcription factor shifts the transcriptome of corneal endothelial progenitors towards the transcriptome of CEC, e.g. mature CEC by at least 1%. In some embodiments, increasing the expression of the at least one transcription factor shifts the transcriptome of corneal endothelial progenitors towards the transcriptome of CEC, e.g., mature CEC by at least 5%. In some embodiments, increasing the expression of the at least one transcription factor shifts the transcriptome of corneal endothelial progenitors towards the transcriptome of CEC, e.g., mature CEC by at least 10%. In some embodiments, increasing the expression of the at least one transcription factor shifts the transcriptome of corneal endothelial progenitors towards the transcriptome of CEC, e.g., mature CEC by at least 20%. In some embodiments, increasing the expression of the at least one transcription factor shifts the transcriptome of corneal endothelial progenitors towards the transcriptome of CEC, e.g., mature CEC by at least 30%. In some embodiments, increasing the expression of the at least one transcription factor shifts the transcriptome of corneal endothelial progenitors towards the transcriptome of CEC, e.g., mature CEC by at least 40%. In some embodiments, increasing the expression of the at least one transcription factor shifts the transcriptome of corneal endothelial cells towards the transcriptome of CEC, e.g., mature CEC mature by at least 50%.

Assessment of the level of expression of such markers in CEC, e.g., mature CEC can be determined in comparison with other cells, e.g., primary CEC, corneal endothelial progenitors, neural crest cells and vascular endothelial cells. Positive controls for the markers of CEC, e.g., mature CEC include adult corneal endothelial cells of the species of interest, e.g., primary human corneal endothelial cells.

Tissue-specific (e.g., corneal endothelial cell-specific) protein and oligosaccharide determinants listed in this disclosure can be detected using any suitable immunological technique—such as flow immunocytochemistry for cell-surface markers, immunohistochemistry (for example, of fixed cells or tissue sections) for intracellular or cell-surface markers, Western blot analysis of cellular extracts, and enzyme-linked immunoassay, for cellular extracts or products secreted into the medium. Expression of an antigen by a cell is said to be "antibody-detectable" if a significantly detectable amount of antibody will bind to the antigen in a standard immunocytochemistry or flow cytometry assay, optionally after fixation of the cells, and optionally using a labeled secondary antibody or other conjugate (such as a biotin-avidin conjugate) to amplify labeling.

The expression of tissue-specific (e.g., CEC, e.g., mature CEC-specific) markers can also be detected at the mRNA level by Northern blot analysis, dot-blot hybridization analysis, or by real time polymerase chain reaction (RT-PCR) using sequence-specific primers in standard amplification methods (U.S. Pat. No. 5,843,780). Sequence data for the particular markers listed in this disclosure can be obtained from public databases such as GenBank. Expression at the mRNA level is said to be "detectable" according to one of the assays described in this disclosure if the performance of the assay on cell samples according to standard procedures in a typical controlled experiment results in clearly discernable hybridization or amplification product within a standard time window. Unless otherwise required, expression of a particular marker is indicated if the corresponding mRNA is detectable by RT-PCR. Expression of tissue-specific markers as detected at the protein or mRNA level is considered positive if the level is at least 2-fold, and preferably more than 10- or 50-fold above that of a control cell, such as an undifferentiated pluripotent stem cell, a fibroblast, or other unrelated cell type.

CEC, e.g., mature CEC can also be characterized according to whether they display the ability to form a "leaky pump" which allows leakage of solutes and nutrients from the aqueous humor to the more superficial layers of the cornea while at the same time actively pumping water in the opposite direction, from the stroma to the aqueous. The pump function of CEC can be evaluated by methods known in the art, for example, as described in Mimuara et al., 2004 Investigative Opthamology and Visual Science, 45:9, pp. 2992-2997. To determine a change in pump function in CEC, e.g., mature CEC derived from pluripotent stem cells, e.g. induced pluripotent stem cells or embryonic stem cells, or corneal endothelial progenitors that express a transcription factor of the invention, pump function can be compared to cultured primary CEC (e.g., human), unmodified corneal endothelial progenitors, and/or undifferentiated cells (pluripotent stem cells, neural crest stem cells etc.). Addition of ouabain (Na/K ATPase inhibitor) will eliminate the pump function, and allows for evaluation of the presence/absence of pump function.

CEC, e.g., mature CEC can also be characterized by the level of resistance to oxidative stress. Resistance to oxidative stress can be measured by qPCR to determine the level of expression of oxidative stress pathway genes (NRF2, NOS2 etc.) and by measuring Reactive Oxygen Species (ROS) level in the cells using ROS biomarkers such as nitrotyrosine and CellRox (CellROX™ Reagent Variety Pack, for oxidative stress detection, Thermofisher C1044). Response to oxidative stress can be evaluated by methods know in the art, for example as described in Guha et al. 2017, Nature Scientific Reports, 4:4074 (I DOI:10.1038/s41598-017-03654-4). To determine a change in resistance to oxidative stress in CEC derived from pluripotent stem cells, e.g., induced pluripotent stem cells or embryonic stem cells, or corneal endothelial progenitors that express a transcription factor of the invention, the level of resistance to oxidative stress can be compared to cultured primary CEC (e.g., human), unmodified corneal endothelial progenitors, and/or undifferentiated cells (pluripotent stem cells, neural crest stem cells etc.).

A further feature of CEC, e.g., mature CEC is their predominantly polygonal or hexagonal shape.

In still another aspect, CEC, e.g., mature CEC can be assessed for their ability to engraft and/or exhibit long-term survival in a subject. In an embodiment, in order to determine whether CEC, e.g., mature CEC survive and maintain their phenotype in vivo, CEC are administered to the cornea of an appropriate animal (as described herein). Corneal tissue is harvested after a period of a few days to several weeks or more, to assess the presence and phenotype of the administered cells, e.g., by immunohistochemistry or ELISA using human-specific antibody, or by RT-PCR analysis. Suitable markers for assessing gene expression at the mRNA or protein level are provided in this disclosure. Effects on corneal function can also be determined by evaluating markers of pump function or tight junctions.

In some embodiments, the CEC, e.g., mature CEC engraft into a cornea of the recipient subject. In some embodiments, the CEC, e.g., mature CEC comprise a population of CEC, e.g., mature CEC, wherein at least 0.1%, 0.2%, 0.5%, 1%, 2%, 3%, 4%, 5%, 10%, 20%, 30%, 40%, 50%, 60%, 70%, 80%, 90%, or 100% of the CEC, e.g., mature CEC engraft into the cornea of the recipient subject.

II. Cells and Compositions of the Invention

A further aspect of the invention provides a composition comprising a population of CEC, e.g., mature CEC, for example, produced according to any of the methods described herein. The invention also provides a composition comprising a population of CEC, e.g., mature CEC, comprising an exogenous transcription factor or nucleic acid encoding the transcription factor. The invention also provides for a composition comprising a population of pluripotent stem cells, e.g., induced pluripotent stem cells or embryonic stem cells, a population of neural crest stem cells, or a population of corneal endothelial progenitors comprising an exogenous transcription factor or nucleic acid encoding the transcription factor.

In some embodiments, the composition is an enriched, purified or isolated population of CEC, neural crest stem cells, corneal endothelial progenitors or pluripotent stem cells, for example, produced according to any of the methods described herein. The enriched, purified or isolated population of CEC, neural crest stem cells, corneal endothelial progenitors or pluripotent stem cells can be single cell suspensions, aggregates, chimeric aggregates, and/or structures, including branched structures and/or cysts.

In some embodiments, the population of CEC, e.g., mature CEC comprise increased expression levels of at least one transcription factor selected from the group consisting of PITX2, FOXC1, TFAP2B, LMX1B and POU6F2, relative to endogenous expression levels of the transcription factor in the population of CEC, e.g., mature CEC.

In some embodiments, the increased expression of PITX2 comprises an increase of at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of PITX2 in the population of CEC. In some embodiments, the increased expression of PITX2 comprises an increase of at least 0.1-fold relative to endogenous expression levels of PITX2 in the population of CEC. In some embodiments, the increased expression of PITX2 comprises an increase of at least 0.2-fold relative to endogenous expression levels of PITX2 in the population of CEC. In some embodiments, the increased expression of PITX2 comprises an increase of at least 0.5-fold relative to endogenous expression levels of PITX2 in the population of CEC. In some embodiments, the increased expression of PITX2 comprises an increase of at least 1-fold relative to endogenous expression levels of PITX2 in the population of CEC. In some embodiments, the increased expression of PITX2 comprises an increase of at least 2-fold relative to endogenous expression levels of PITX2 in the population of CEC. In some embodiments, the increased expression of PITX2 comprises an increase of at least 5-fold relative to endogenous expression levels of PITX2 in the population of CEC. In some embodiments, the increased expression of PITX2 comprises an increase of at least 10-fold relative to endogenous expression levels of PITX2 in the population of CEC. In some embodiments, the increased expression of PITX2 comprises an increase of at least 20-fold relative to endogenous expression levels of PITX2 in the population of CEC. In some embodiments, the increased expression of PITX2 comprises an increase of at least 50-fold relative to endogenous expression levels of PITX2 in the population of CEC. In some embodiments, the increased expression of PITX2 comprises an increase of at least 100-fold relative to endogenous expression levels of PITX2 in the population of CEC. In some embodiments, the increased expression of PITX2 comprises an increase of at least 200-fold relative to endogenous expression levels of PITX2 in the population of CEC. In some embodiments, the increased expression of PITX2 comprises an increase of at least 500-fold relative to endogenous expression levels of PITX2 in the population of CEC. In some embodiments, the increased expression of PITX2 comprises an increase of at least 1,000-fold relative to endogenous expression levels of PITX2 in the population of CEC. In some embodiments, the increased expression of PITX2 comprises an increase of at least 10,000-fold relative to endogenous expression levels of Pitx2 in the population of CEC. In any of the above embodiments, the CEC may be mature CEC.

In some embodiments, the increased expression of FOXC1 comprises an increase of at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of FOXC1 in the population of CEC. In some embodiments, the increased expression of FOXC1 comprises an increase of at least 0.1-fold relative to endogenous expression levels of FOXC1 in the population of CEC. In some embodiments, the increased expression of FOXC1 comprises an increase of at least 0.2-fold relative to endogenous expression levels of FOXC1 in the population of CEC. In some embodiments, the increased expression of FOXC1 comprises an increase of at least 0.5-fold relative to endogenous expression levels of FOXC1 in the population of CEC. In some embodiments, the increased expression of FOXC1 comprises an increase of at least 1-fold relative to endogenous expression levels of FOXC1 in the population of CEC. In some embodiments, the increased expression of FOXC1 comprises an increase of at least 2-fold relative to endogenous expression levels of FOXC1 in the population of CEC. In some embodiments, the increased expression of FOXC1 comprises an increase of at least 5-fold relative to endogenous expression levels of FOXC1 in the population of CEC. In some embodiments, the increased expression of FOXC1 comprises an increase of at least 10-fold relative to endogenous expression levels of FOXC1 in the population of CEC. In some embodiments, the increased expression of FOXC1 comprises an increase of at least 20-fold relative to endogenous expression levels of FOXC1 in the population of CEC. In some embodiments, the increased expression of FOXC1 comprises an increase of at least 50-fold relative to endogenous expression levels of FOXC1 in the population of CEC. In some embodiments, the increased expression of FOXC1 comprises an increase of at least 100-fold relative to endogenous expression levels of FOXC1 in the population of CEC. In some embodiments, the increased expression of FOXC1 comprises an increase of at least 200-fold relative to endogenous expression levels of FOXC1 in the population of CEC. In some embodiments, the increased expression of FOXC1 comprises an increase of at least 500-fold relative to endogenous expression levels of FOXC1 in the population of CEC. In some embodiments, the increased expression of FOXC1 comprises an increase of at least 1,000-fold relative to endogenous expression levels of FOXC1 in the population of CEC. In some embodiments, the increased expression of FOXC1 comprises an increase of at least 10,000-fold relative to endogenous expression levels of FOXC1 in the population of CEC. In any of the above embodiments, the CEC may be mature CEC.

In some embodiments, the increased expression of TFAP2B comprises an increase of at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of TFAP2B in the population of CEC. In some embodiments, the increased expression of TFAP2B comprises an increase of at least 0.1-fold relative to endogenous expression levels of TFAP2B in the population of CEC. In some embodiments, the increased expression of TFAP2B comprises an increase of at least 0.2-fold relative to endogenous expression levels of TFAP2B in the population of CEC. In some embodiments, the increased expression of TFAP2B comprises an increase of at least 0.5-fold relative to endogenous expression levels of TFAP2B in the population of CEC. In some embodiments, the increased expression of TFAP2B comprises an increase of at least 1-fold relative to endogenous expression levels of TFAP2B in the population of CEC. In some embodiments, the increased expression of TFAP2B comprises an increase of at least 2-fold relative to endogenous expression levels of TFAP2B in the population of CEC. In some embodiments, the increased expression of TFAP2B comprises an increase of at least 5-fold relative to endogenous expression levels of TFAP2B in the population of CEC. In some embodiments, the increased expression of TFAP2B comprises an increase of at least 10-fold relative to endogenous expression levels of TFAP2B in the population of CEC. In some embodiments, the increased expression of TFAP2B comprises an increase of at least 20-fold relative to endogenous expression levels of TFAP2B in the population of CEC. In some embodiments, the increased expression of TFAP2B comprises an increase of at least 50-fold relative to endogenous expression levels of TFAP2B in the population of CEC. In some embodiments, the increased expression of TFAP2B comprises an increase of at least 100-fold relative to endogenous expression levels of TFAP2B in the population of CEC. In some embodiments, the increased expression of TFAP2B comprises an increase of at least 200-fold relative to endogenous expression levels of TFAP2B in the population of CEC. In some embodiments, the increased expression of TFAP2B comprises an increase of at least 500-fold relative to endogenous expression levels of TFAP2B in the population of CEC. In some embodiments, the increased expression of TFAP2B comprises an increase of at least 1,000-fold relative to endogenous expression levels of TFAP2B in the population of CEC. In some embodiments, the increased expression of TFAP2B comprises an increase of at least 10,000-fold relative to endogenous expression levels of TFAP2B in the population of CEC. In any of the above embodiments, the CEC may be mature CEC.

In some embodiments, the increased expression of LMX1B comprises an increase of at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of LMX1B in the population of CEC. In some embodiments, the increased expression of LMX1B comprises an increase of at least 0.1-fold relative to endogenous expression levels of LMX1B in the population of CEC. In some embodiments, the increased expression of LMX1B comprises an increase of at least 0.2-fold relative to endogenous expression levels of LMX1B in the population of CEC. In some embodiments, the increased expression of LMX1B comprises an increase of at least 0.5-fold relative to endogenous expression levels of LMX1B in the population of CEC. In some embodiments, the increased expression of LMX1B comprises an increase of at least 1-fold relative to endogenous expression levels of LMX1B in the population of CEC. In some embodiments, the increased expression of LMX1B comprises an increase of at least 2-fold relative to endogenous expression levels of LMX1B in the population of CEC. In some embodiments, the increased expression of LMX1B comprises an increase of at least 5-fold relative to endogenous expression levels of LMX1B in the population of CEC. In some embodiments, the increased expression of LMX1B comprises an increase of at least 10-fold relative to endogenous expression levels of LMX1B in the population of CEC. In some embodiments, the increased expression of LMX1B comprises an increase of at least 20-fold relative to endogenous expression levels of LMX1B in the population of CEC. In some embodiments, the increased expression of LMX1B comprises an increase of at least 50-fold relative to endogenous expression levels of LMX1B in the population of CEC. In some embodiments, the increased expression of LMX1B comprises an increase of at least 100-fold relative to endogenous expression levels of LMX1B in the population of CEC. In some embodiments, the increased expression of LMX1B comprises an increase of at least 200-fold relative to endogenous expression levels of LMX1B in the population of CEC. In some embodiments, the increased expression of LMX1B comprises an increase of at least 500-fold relative to endogenous expression levels of LMX1B in the population of CEC. In some embodiments, the increased expression of LMX1B comprises an increase of at least 1,000-fold relative to endogenous expression levels of LMX1B in the population of CEC. In some embodiments, the increased expression of LMX1B comprises an increase of at least 10,000-fold relative to endogenous expression levels of LMX1B in the population of CEC. In any of the above embodiments, the CEC may be mature CEC.

In some embodiments, the increased expression of POU6F2 comprises an increase of at least 0.1-fold, 0.2-fold, 0.5-fold, 1-fold, 2-fold, 5-fold, 10-fold, 20-fold, 50-fold, 100-fold, 200-fold, 500-fold, 1000-fold, or 10,000-fold relative to endogenous expression levels of POU6F2 in the population of CEC. In some embodiments, the increased expression of POU6F2 comprises an increase of at least 0.1-fold relative to endogenous expression levels of POU6F2 in the population of CEC. In some embodiments, the increased expression of POU6F2 comprises an increase of at least 0.2-fold relative to endogenous expression levels of POU6F2 in the population of CEC. In some embodiments, the increased expression of POU6F2 comprises an increase of at least 0.5-fold relative to endogenous expression levels of POU6F2 in the population of CEC. In some embodiments, the increased expression of POU6F2 comprises an increase of at least 1-fold relative to endogenous expression levels of POU6F2 in the population of CEC. In some embodiments, the increased expression of POU6F2 comprises an increase of at least 2-fold relative to endogenous expression levels of POU6F2 in the population of CEC. In some embodiments, the increased expression of POU6F2 comprises an increase of at least 5-fold relative to endogenous expression levels of POU6F2 in the population of CEC. In some embodiments, the increased expression of POU6F2 comprises an increase of at least 10-fold relative to endogenous expression levels of POU6F2 in the population of CEC. In some embodiments, the increased expression of POU6F2 comprises an increase of at least 20-fold relative to endogenous expression levels of POU6F2 in the population of CEC. In some embodiments, the increased expression of POU6F2 comprises an increase of at least 50-fold relative to endogenous expression levels of POU6F2 in the population of CEC. In some embodiments, the increased expression of POU6F2 comprises an increase of at least 100-fold relative to endogenous expression levels of POU6F2 in the population of CEC. In some embodiments, the increased expression of POU6F2 comprises an increase of at least 200-fold relative to endogenous expression levels of POU6F2 in the population of CEC. In some embodiments, the increased expression of POU6F2 comprises an increase of at least 500-fold relative to endogenous expression levels of POU6F2 in the population of CEC. In some embodiments, the increased expression of POU6F2 comprises an increase of at least 1,000-fold relative to endogenous expression levels of POU6F2 in the population of CEC. In some embodiments, the increased expression of POU6F2 comprises an increase of at least 10,000-fold relative to endogenous expression levels of POU6F2 in the population of CEC. In any of the above embodiments, the CEC may be mature CEC.

In some embodiments, the population of CEC, e.g., mature CEC further comprise increased expression levels of one or more transcription factors selected from the group consisting of ERG, ATF4, ATMIN, BHLHE40, CEBPD, CSRNP1, DRAP1, EGR1, ELF2, EMX2, ESRRA, ETS2, FOS, FOSB, FOSL2, GTF3A, HIF1A, JUN, JUN B, JUN D, KLF10, KLF9, MBD3, NFE2L1, NME2, NR1D1, NR4A1, PA2G4, POU3F3, RELA, TBX2, TFDP1, TSC22D1, USF2, YBX1, ZNF207, ZNF358, and ZNF395 relative to endogenous expression levels of the one or more transcription factors in the population of CEC, e.g., mature CEC. In some embodiments, the one or more transcription factor is ERG. In some embodiments, the one or more transcription factor is BHLHE40. In some embodiments, the one or more transcription factor is CEBPD. In some embodiments, the one or more transcription factor is CSRNP1. In some embodiments, the one or more transcription factor is EGR1. In some embodiments, the one or more transcription factor is ESRRA. In some embodiments, the one or more transcription factor is ETS2. In some embodiments, the one or more transcription factor is FOS. In some embodiments, the one or more transcription factor is FOSB. In some embodiments, the one or more transcription factor is FOSL2. In some embodiments, the one or more transcription factor is JUN. In some embodiments, the one or more transcription factor is JUNB. In some embodiments, the one or more transcription factor is JUND. In some embodiments, the one or more transcription factor is KLF10. In some embodiments, the one or more transcription factor is KLF9. In some embodiments, the one or more transcription factor is NR1D1. In some embodiments, the one or more transcription factor is NR4A1. In some embodiments, the one or more transcription factor is TSC22D1.

In some embodiments, the population of CEC is a population of corneal endothelial progenitors. In some embodiments, the population of CEC is a population of mature CEC. In some embodiments, the population of CEC comprises both mature CEC and corneal endothelial progenitors.

In some embodiments, the composition of a population of CEC comprises about $1\times10^6$ CEC to about $1\times10^{12}$ CEC. In some embodiments, the composition of a population of CEC comprises at least $1\times10^5$, $1\times10^6$, $1\times10^7$, $1\times10^8$, $1\times10^9$, $1\times10^{10}$, $1\times10^{11}$, or $1\times10^{12}$ CEC.

Also provided herein are pharmaceutical compositions and formulations comprising CEC, e.g., mature CEC or corneal endothelial progenitors, and a pharmaceutically acceptable carrier.

In some embodiments, the pharmaceutical composition comprises a dose ranging from about $1\times10^6$ CEC to about $1\times10^{12}$ CEC. In some embodiments, the dose is about $1\times10^5$, $1\times10^6$, $1\times10^7$, $1\times10^8$, $1\times10^9$, $1\times10^{10}$, $1\times10^{11}$, or $1\times10^{12}$ CEC. In some embodiments, a pharmaceutical composition comprises a dose ranging from about $1\times10^6$ CEC to about $1\times10^{12}$ CEC.

A further aspect of the invention provides a composition comprising a population of pluripotent stem cells comprising an expression vector, wherein the expression vector comprises a nucleic acid encoding at least one transcription factor of the disclosure.

In some embodiments, the transcription factor is one or more of PITX2, FOXC1, TFAP2B, LMX1B, and POU6F2. In some embodiments, the transcription factor is PITX2. In some embodiments, the transcription factor is FOXC1. In some embodiments, the transcription factor is TFAP2B. In some embodiments, the transcription factor is LMX1B. In some embodiments, the transcription factor is POU6F2.

In some embodiments, the population of pluripotent stem cells further comprise an expression vector comprising a nucleic acid encoding one or more transcription factor selected from the group consisting of: ERG, ATF4, ATMIN, BHLHE40, CEBPD, CSRNP1, DRAP1, EGR1, ELF2, EMX2, ESRRA, ETS 2, FOS, FOSB, FOSL2, GTF3A, HIF1A, JUN, JUNB, JUND, KLF10, KLF9, MBD3, NFE2L1, NME2, NR1D1, NR4A1, PA2G4, POU3F3, RELA, TBX2, TFDP1, TSC22D1, USF2, YBX1, ZNF207, ZNF358, and ZNF395.

In some embodiments, the composition comprising a population of pluripotent stem cells comprises about $1\times10^6$ pluripotent stem cells to about $1\times10^{12}$ pluripotent stem cells. In some embodiments, the composition comprising a population of pluripotent stem cells comprises at least $1\times10^5$, $1\times10^6$, $1\times10^7$, $1\times10^8$, $1\times10^9$, $1\times10^{10}$, $1\times10^{11}$, or $1\times10^{12}$ pluripotent stem cells.

In some embodiments, the pluripotent stem cells are embryonic stem cells. In some embodiments, the pluripotent stem cells are induced pluripotent stem cells.

A further aspect of the invention provides a composition comprising a population of corneal endothelial progenitors comprising an expression vector, wherein the expression vector comprises a nucleic acid encoding at least one transcription factor of the disclosure.

In some embodiments, the transcription factor is one or more of PITX2, FOXC1, TFAP2B, LMX1B, and POU6F2. In some embodiments, the transcription factor is PITX2. In some embodiments, the transcription factor is FOXC1. In some embodiments, the transcription factor is TFAP2B. In some embodiments, the transcription factor is LMX1B. In some embodiments, the transcription factor is POU6F2.

In some embodiments, the population of corneal endothelial progenitors further comprise an expression vector comprising a nucleic acid encoding one or more transcription factor selected from the group consisting of: ERG, ATF4, ATMIN, BHLHE40, CEBPD, CSRNP1, DRAP1, EGR1, ELF2, EMX2, ESRRA, ETS2, FOS, FOSB, FOSL2, GTF3A, HIF1A, JUN, JUNB, JUND, KLF10, KLF9, MBD3, NFE2L1, NME2, NR1D1, NR4A1, PA2G4, POU3F3, RELA, TBX2, TFDP1, TSC22D1, USF2, YBX1, ZNF207, ZNF358, and ZNF395.

In some embodiments, the composition comprising a population of corneal endothelial progenitors comprises about $1\times10^6$ corneal endothelial progenitors to about $1\times10^{12}$ corneal endothelial progenitors. In some embodiments, the composition comprising a population of corneal endothelial progenitors comprises at least $1\times10^5$, $1\times10^6$, $1\times10^7$, $1\times10^8$, $1\times10^9$, $1\times10^{10}$, $1\times10^{11}$, or $1\times10^{12}$ corneal endothelial progenitors.

Also provided herein are pharmaceutical compositions and formulations comprising corneal endothelial progenitors, and a pharmaceutically acceptable carrier.

In some embodiments, the pharmaceutical composition comprises a dose ranging from about $1\times10^6$ corneal endothelial progenitors to about $1\times10^{12}$ corneal endothelial progenitors. In some embodiments, the dose is about $1\times10^5$, $1\times10^6$, $1\times10^7$, $1\times10^8$, $1\times10^9$, $1\times10^{10}$, $1\times10^{11}$, or $1\times10^{12}$ corneal endothelial progenitors. In some embodiments, a pharmaceutical composition comprises a dose ranging from about $1\times10^6$ corneal endothelial progenitors to about $1\times10^{12}$ corneal endothelial progenitors.

Pharmaceutical compositions and formulations as described herein can be prepared by mixing the CEC, e.g., mature CEC, with one or more optional pharmaceutically acceptable carriers (Remington's Pharmaceutical Sciences 22nd edition, 2012; incorporated in its entirety herein reference), in the form of aqueous solutions. Pharmaceutically acceptable carriers are generally nontoxic to recipients at the dosages and concentrations employed, and include, but are not limited to: buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as polyethylene glycol (PEG). Exemplary pharmaceutically acceptable carriers herein further include insterstitial drug dispersion agents such as soluble neutral-active hyaluronidase glycoproteins (sHASEGP), for example, human soluble PH-20 hyaluronidase glycoproteins, such as rHuPH20 (HYLENEX®, Baxter International, Inc.). Certain exemplary sHASEGPs and methods of use, including rHuPH20, are described in US Patent Publication Nos. 2005/0260186 and 2006/0104968; each of which is incorporated in its entirety herein reference. In one aspect, a sHASEGP is combined with one or more additional glycosaminoglycanases such as chondroitinases.

In certain embodiments, the composition and pharmaceutical composition comprising CEC comprise a substantially purified population of CEC. For example, the composition of CEC may contain less than 25%, 20%, 15%, 10%, 9%, 8%, 7%, 6%, 5%, 4%, 3%, 2%, or less than 1% of cells other than CEC. In some embodiments, the composition of CEC contains less than 25%, 20%, 15%, 10%, 9%, 8%, 7%, 6%, 5%, 4%, 3%, 2%, or less than 1% of pluripotent stem cells. In another embodiment, the composition of CEC is devoid of or is undetectable for pluripotent stem cells. In some embodiments, the composition of CEC contains less than 25%, 20%, 15%, 10%, 9%, 8%, 7%, 6%, 5%, 4%, 3%, 2%, or less than 1% of corneal endothelial progenitors. In another embodiment, the composition of CEC is devoid of or is undetectable for corneal endothelial progenitors. In some embodiments, the composition comprising a substantially purified population of CEC is one in which the CEC, comprise at least about 75% of the cells in the composition. In other embodiments, a substantially purified population of CEC is one in which the CEC comprise at least about 80%, 85%, 90%, 91%, 92%, 93%, 94%, 95%, 96%, 97%, 97.5%, 98%, 99%, or even greater than 99% of the cells in the population. In any of the embodiments, the substantially purified population of CEC may be a substantially purified population of mature CEC.

III. Methods of Use of Corneal Endothelial Cells

CEC, e.g., mature CEC and pharmaceutical compositions produced by the methods described herein may be used for cell-based treatments for ocular disorders including disorders of the cornea, in which corneal endothelial cells are needed or would improve treatment. Methods of using CEC, e.g., mature CEC provided by the present invention for treating various conditions that may benefit from corneal endothelial cell-based therapies are described herein. The particular treatment regimen, route of administration, and any adjuvant therapy will be tailored based on the particular condition, the severity of the condition, and the patient's overall health. Additionally, in certain embodiments, administration of CEC, e.g., mature CEC may be effective to fully restore loss of corneal function or other symptoms. In other embodiments, administration of CEC, e.g., mature CEC may be effective to reduce the severity of the symptoms and/or to prevent further degeneration in the patient's condition. The invention contemplates that administration of a composition comprising CEC, e.g., mature CEC can be used to treat (including reducing the severity of the symptoms, in whole or in part) any of the conditions described herein.

The invention contemplates that CEC, e.g., mature CEC, including compositions comprising CEC, e.g., mature CEC, derived using any of the methods described herein can be used in the treatment of any of the indications described herein. Further, the invention contemplates that any of the compositions comprising CEC, e.g., mature CEC described herein can be used in the treatment of any of the indications described herein.

In an embodiment, the present disclosure provides therapeutic methods for the prevention and/or treatment of disease, preferably diseases affecting corneal endothelial cells or amenable to treatment by the transplantation or administration thereof, including, for example, primary diseases such as Fuch's dystrophy, iridocorneal endothelial syndrome, posterior polymorphous dystrophy, and congenital hereditary endothelial dystrophy, and secondary diseases for which an effective treatment is replacement of the corneal endothelium including corneal dystrophies, or wherein a subject exhibits symptoms of corneal edema leading to Bullous Keratopathy, wherein a subject has ocular damage due to contact lens usage or cataract surgery, or wherein a subject is considering corneal transplantation and late endothelial failure in cornea transplantation.

In another embodiment, the CEC, e.g., mature CEC of the invention may be administered with other therapeutic cells or agents. The CEC, e.g., mature CEC may be administered simultaneously in a combined or separate formulation, or sequentially. Therapeutic methods may include administration of an immunosuppressive agent. Immunosuppressants that may be used include but are not limited to anti-lymphocyte globulin (ALG) polyclonal antibody, anti-thymocyte globulin (ATG) polyclonal antibody, azathioprine, BASILIXIMAB® (anti-IL-2R.alpha. receptor antibody), cyclosporin (cyclosporin A), DACLIZUMAB® (anti-IL-2R.alpha. receptor antibody), everolimus, mycophenolic acid, RITUXIMAB® (anti-CD20 antibody), sirolimus, tacrolimus, mycophemolate mofetil, corticosteroids and mesenchymal stem cells. The immunosuppressants may be dosed at least about 1, 2, 4, 5, 6, 7, 8, 9, or 10 mg/kg. When immunosuppressants are used, they may be administered systemically or locally, and they may be administered prior to, concomitantly with, or following administration of the CEC, e.g., mature CEC. Immunosuppressive therapy may continue for weeks, months, years, or indefinitely following administration of cells. For example, the patient may be administered 5 mg/kg cyclosporin for 6 weeks following administration of the CEC, e.g., mature CEC. Furthermore, a composition of CEC, e.g., mature CEC may comprise an immunosuppressive agent, e.g., any of the foregoing.

CEC, e.g., mature CEC of the invention may be administered with agents that promote cell attachment, engraftment and/or survival. CEC of the invention may be administered with a ROCK inhibitor, e.g., Y27632, and an extracellular matrix protein, e.g., fibronectin. CEC, e.g., mature CEC of the invention may be administered with one or more anti-apoptotic agents, anti-inflammatory agents, anti-oxidants and extracellular matrix protein (e.g., fibronectin, laminin, truncated E8 fragments of laminin (e.g., iMatrix 511), collagens (type I, II, III, IV, VIII, etc.), etc.

The CEC, e.g., mature CEC provided by methods and compositions of the invention can also be used in a variety of applications. These include but are not limited to transplantation or implantation of the corneal endothelial cells in vivo; screening for cytotoxic compounds, carcinogens, mutagens growth/regulatory factors, or pharmaceutical compounds in vitro; elucidating the mechanism of corneal diseases and infections; studying the mechanism by which drugs and/or growth factors operate; diagnosing and monitoring cancer in a patient; gene therapy; and the production of biologically active products. In some embodiments, the corneal endothelial cells comprise mature corneal endothelial cells, neural crest stem cells, corneal endothelial progenitors or a combination thereof.

Test Compound Screening

The CEC, e.g., mature CEC of the invention can be used to screen for factors (such as solvents, small molecule drugs, peptides, and polynucleotides) or environmental conditions (such as culture conditions or manipulation) that affect the characteristics of corneal endothelial cells provided herein.

In some applications, stem cells (differentiated or undifferentiated) are used to screen factors that promote maturation of cells along the corneal endothelial cell lineage or promote proliferation and maintenance of such cells in long-term culture. For example, candidate corneal endothelial cell maturation factors or growth factors are tested by adding them to stem cells in different wells, and then determining any phenotypic change that results, according to desirable criteria for further culture and use of the cells.

Particular screening applications of this invention relate to the testing of pharmaceutical compounds in drug research, for example, as described in In vitro Methods in Pharmaceutical Research, Academic Press, 1997, and U.S. Pat. No. 5,030,015; each of which is incorporated in its entirety herein by reference. Assessment of the activity of candidate pharmaceutical compounds generally involves combining the CEC, e.g., mature CEC s provided in certain aspects of this invention with the candidate compound, determining any change in the morphology, marker phenotype, or metabolic activity of the cells that is attributable to the compound (compared with untreated cells or cells treated with an inert compound), and then correlating the effect of the compound with the observed change. The screening may be done either because the compound is designed to have a pharmacological effect on corneal endothelial cells, or because a compound designed to have effects elsewhere may have unintended corneal side effects. Two or more drugs can be tested in combination (by combining with the cells either simultaneously or sequentially), to detect possible drug-drug interaction effects.

Corneal Therapy and Transplantation

The invention also provides the use of CEC, e.g., mature CEC described herein to restore a degree of ocular function to a subject in need thereof.

To determine the suitability of CEC, e.g., mature CEC provided herein for therapeutic applications, the cells can first be tested in a suitable animal model. Suitable animals include a rabbit CEC scraping model (Okumura et al., 2017 Am. J. Pathol., 2012, 181(1): 268-277) or a monkey CEC scraping model (Okumura et al, 2016, Nature Scientific Reports, 6:26113, DOI: 10.1038/srep26113). Additional models useful for the invention include rodent models such as L450W and Q455K Col8a2 knock in mouse models of Fuchs Endothelial Corneal Dystrophy (Meng et al., 2013, Invest. Opthamol. Vis. Sci. 54(3):1887-189) and a mouse SLC4A11 knock out model (Groger et al. 2010, J. Biol. Chem., 285(19): 14467). Such models are useful for assessing the ability of CEC, e.g., mature CEC to survive and maintain their phenotype in vivo. CEC, e.g., mature CEC provided herein are administered to the animal. Tissues are harvested after a period of a few days to several weeks or more and assessed. This can be performed by providing the administered cells with a detectable label (such as green fluorescent protein, or β-galactosidase); or by measuring a constitutive marker specific for the administered cells. The presence and phenotype of human CEC, e.g., mature CEC administered to a rodent can be assessed by immunohistochemistry or ELISA using human-specific antibody, or by RT-PCR analysis using primers and hybridization conditions that cause amplification to be specific for human polynucleotide sequences. Suitable markers for assessing gene expression at the mRNA or protein level are provided herein.

CEC, e.g., mature CEC provided in certain aspects of this invention that demonstrate desirable functional characteristics described herein, or efficacy in animal models, may also be suitable for direct administration to human subjects with corneal impairment. In one aspect, the present disclosure provides therapeutic methods comprising transplantation of a cultured sheet or monolayer or spheroid of CEC, e.g., mature CEC or precursors thereof into the eye of a subject in need thereof, e.g., an individual suffering from a disease of corneal endothelial cells. For example, the eye of the subject may be prepared by removal of the Descemet's membrane, and said cultured sheet or monolayer or spheroid of CEC, e.g., mature CEC may be placed into the anterior chamber of said eye, e.g., in contact with (and preferably attached or affixed to) the posterior corneal stroma. Optionally, the sheet or monolayer or spheroid of CEC, e.g., mature CEC or precursors thereof may be provided on a carrier and administered to an eye of a patient.

One treatment which may be clinically preferred when only the corneal endothelium is compromised is Descemet's stripping with endothelial keratoplasty (DSEK), which includes the removal of diseased Descemet's membrane and the corneal endothelium, and subsequent transplantation of donor tissue. Procedures have been developed to replace the entire cornea (penetrating keratoplasty or PK) or leave the patient's Descemet's membrane and endothelium and replace the remaining layers with donated tissue (lamellar keratoplasty). See, generally, U.S. Pat. Nos. 5,755,785, 5,649,944, 7,147,648, 7,300,653, 5,584,881, 5,686,414, 7,300,654, U.S. patent application Ser. No. 10/525,391, each of which is incorporated by reference in its entirety. Additional methods of corneal endothelial surgical replacement are under development, including Descemet's Membrane Endothelial Keratoplasty (DMEK), in which the donor tissue consists only of Descemet's membrane and corneal endothelium. Corneal endothelial surgical replacement therapy can be assessed using an appropriate animal model, for example any of the models described herein. CEC, e.g., mature CEC provided in certain aspects of this invention may be used for corneal endothelial reconstruction, in which CEC, e.g., mature CEC are cultured in vitro prior to transplantation. For example, donated human corneal cells are cultured on a polymer, released onto a bioadhesive gelatin disc, and then successfully integrated into denuded rabbit corneas, with the gelatin disc dissolving after transplantation (Hsiue et al., Transplantation. 2006 Feb. 15; 81(3):473-6, which is incorporated by reference herein in its entirety). However, methods utilizing cultured cells presuppose a source of said cells, and thus are affected by the shortage of suitable donated tissues as described above. Additionally, due to differences among donated cells, it may prove difficult to produce corneal endothelial cell cultures of consistent quality and efficacy. Regulatory hurdles may also make such methods logistically difficult to perform on a large scale, due to the possibility that extensive testing for safety and/or efficacy may be required for the cells obtained from each donor. These and additional therapeutic methods are further described in Thomas John, Corneal Endothelial Transplant: DSAEK, DMEK & DLEK (JP Medical Ltd, 2010), which is incorporated by reference herein in its entirety.

The CEC, e.g., mature CEC provided in certain aspects of this invention can be used for therapy of any subject in need of having ocular function restored or supplemented. Human conditions that may be appropriate for such therapy include primary diseases such as Fuch's dystrophy, iridocorneal endothelial syndrome, posterior polymorphous dystrophy, and congenital hereditary endothelial dystrophy, and secondary diseases for which an effective treatment is replacement of the corneal endothelium including corneal dystrophies, or wherein a subject exhibits symptoms of corneal edema leading to Bullous Keratopathy, wherein a subject has ocular damage due to contact lens usage or cataract surgery, or wherein a subject is considering corneal transplantation For human therapy, the dose is generally between about $10^9$ and $10^{12}$ cells, and typically between about $5\times10^9$ and $5\times10^{10}$ cells, making adjustments for the body weight of the subject, nature and severity of the affliction, and the replicative capacity of the administered cells.

The invention also provides methods of use of the CEC, e.g., mature CEC disclosed herein, for example, in combination with other cell types, as organoids. Organoids can be established from the CEC and grown for multiple months, while retaining key morphological, functional and gene expression features.

Further, for purposes of manufacture, distribution, and use, the CEC, e.g., mature CEC of the invention may be supplied in the form of a cell culture or suspension in an isotonic excipient or culture medium, optionally frozen to facilitate transportation or storage.

Compositions of the present disclosure may be in a formulation suitable for use in treating a human patient, such as pyrogen-free or essentially pyrogen-free, and pathogen-free. When administered, the pharmaceutical preparations for use in this disclosure may be in a pyrogen-free, pathogen-free, physiologically acceptable form. Compositions of the present disclosure may be in a formulation suitable for administration to a non-human veterinarian mammal, such as a dog, cat or horse.

The invention also includes different reagent systems, comprising a set or combination of cells that exist at any time during manufacture, distribution, or use. The cell sets comprise any combination of two or more cell populations described in this disclosure, e.g., CEC, e.g., mature CEC, their precursors and subtypes, in combination with undifferentiated stem cells, somatic cell-derived corneal endothelial cells, or other differentiated cell types. The cell populations in the set sometimes share the same genome or a genetically modified form thereof.

The invention contemplates that compositions of CEC, e.g., mature CEC, for example, obtained from human pluripotent stem cells (e.g., induced pluripotent stem cells, human embryonic stem cells or other pluripotent stem cells) can be used to treat any of the foregoing diseases or conditions. These diseases can be treated with compositions of CEC, e.g., mature CEC comprising CEC of varying levels of maturity, as well as with compositions of CEC that are enriched for mature CEC.

IV. Methods of Administration of Corneal Endothelial Cells

The CEC, e.g., mature CEC of the invention may be administered by any route of administration appropriate for the disease or disorder being treated. In an embodiment, the CEC, e.g., mature CEC of the invention may be administered topically, systemically, or locally, such as by injection, or as part of a device or implant (e.g., a sustained release implant). For example, the CEC, e.g., mature CEC of the present invention may be transplanted into the eye by using surgery when treating a patient with a disorder or disease, such as Fuch's dystrophy, iridocorneal endothelial syndrome, posterior polymorphous dystrophy, and congenital hereditary endothelial dystrophy, and secondary diseases for which an effective treatment is replacement of the corneal endothelium including corneal dystrophies, or wherein a subject exhibits symptoms of corneal edema leading to Bullous Keratopathy, wherein a subject has ocular damage due to contact lens usage or cataract surgery, or wherein a subject is considering corneal transplantation or macular degeneration, Stargardt's disease, and retinitis pigmentosa. One skilled in the art would be able to determine the route of administration for the disease or disorder being treated.

CEC, e.g., mature CEC of the invention may be delivered in a pharmaceutically acceptable formulation by injection. Concentrations for injections may be at any amount that is effective and non-toxic, depending upon the factors described herein. In an embodiment, at least $1\times10^6$, $2\times10^6$, $5\times10^6$, $1\times10^7$, $1\times10^8$, or $1\times10^{10}$ CEC, e.g., mature CEC may be administered to a patient in need thereof.

Products and systems, such as delivery vehicles, comprising the agents of the invention, especially those formulated as pharmaceutical compositions, as well as kits comprising such delivery vehicles and/or systems, are also envisioned as being part of the present invention.

In certain embodiments, a therapeutic method of the invention includes the step of administering CEC, e.g., mature CEC of the invention with an implant or device. In certain embodiments, the device is a bioerodible implant for treating a disease or condition described herein.

The volume of composition administered according to the methods described herein is also dependent on factors such as the mode of administration, number of corneal endothelial cells, age of the patient, and type and severity of the disease being treated.

CEC, e.g., mature CEC are typically delivered one time to a patient. CEC, e.g., mature CEC may be delivered more than once throughout the life of a patient. In certain embodiments, patients are also administered immunosuppressive therapy, either before, concurrently with, or after administration of the CEC, e.g., mature CEC. Immunosuppressive therapy may be necessary throughout the life of the patient, or for a shorter period of time. Examples of immunosuppressive therapy include, but are not limited to, one or more of: anti-lymphocyte globulin (ALG) polyclonal antibody, anti-thymocyte globulin (ATG) polyclonal antibody, azathioprine, BASILIXIMAB® (anti-I L-2Ra receptor antibody), cyclosporin (cyclosporin A), DACLIZUMAB® (anti-I L-2Ra receptor antibody), everolimus, mycophenolic acid, RITUXIMAB® (anti-CD20 antibody), sirolimus, tacrolimus (Prograf™), and mycophemolate mofetil (MMF).

In certain embodiments, CEC, e.g., mature CEC of the present invention are formulated with a pharmaceutically acceptable carrier. For example, CEC may be administered alone or as a component of a pharmaceutical formulation. The CEC, e.g., mature CEC may be formulated for administration in any convenient way for use in human medicine. In certain embodiments, pharmaceutical compositions suitable for parenteral administration may comprise the CEC, e.g., mature CEC in combination with one or more pharmaceutically acceptable sterile isotonic aqueous or nonaqueous solutions, dispersions, suspensions or emulsions, or sterile powders which may be reconstituted into sterile injectable solutions or dispersions just prior to use, which may contain antioxidants, buffers, bacteriostats, solutes which render the formulation isotonic with the blood of the intended recipient or suspending or thickening agents. Examples of suitable aqueous and nonaqueous carriers which may be employed in the pharmaceutical compositions of the invention include water, ethanol, polyols (such as glycerol, propylene glycol, polyethylene glycol, and the like), and suitable mixtures thereof. Proper fluidity can be maintained, for example, by the use of coating materials, such as lecithin, by the maintenance of the required particle size in the case of dispersions, and by the use of surfactants.

V. Kits

An article of manufacture or a kit comprising a population of CEC, e.g., mature CEC, for example, a population of mature CEC, and/or a pharmaceutical composition of the disclosure, is also provided herein. The article of manufacture or kit can further comprise a package insert comprising instructions for using the population of corneal endothelial cells or the pharmaceutical composition of the invention, for example, to treat or delay progression of any disease disclosed herein. The article of manufacture or kit may further include other materials desirable from a commercial and user standpoint, including other buffers, diluents, filters, needles, syringes, and package inserts with instructions for use. In some embodiments, the article of manufacture further includes one or more of another agent (e.g., a chemotherapeutic agent). corneal endothelial cells of the invention may be administered with agents that promote cell attachment, engraftment and/or survival. CEC, e.g., mature CEC of the invention may be administered with a ROCK inhibitor, e.g., Y27632, and an extracellular matrix protein, e.g., fibronectin. CEC, e.g., mature CEC of the invention may be administered with one or more anti-apoptotic agents, anti-inflammatory agents, anti-oxidants and extracellular matrix protein (e.g., fibronectin, laminin, truncated E8 fragments of laminin (e.g., iMatrix 511), collagens (type I, II, III, IV, VIII, etc.), etc. CEC, e.g., mature CEC of the invention may be administered in combination with magnetic beads or nanoparticles to facilitate delivery of CEC, e.g., mature CEC.

Suitable containers for the one or more agent include, for example, bottles, vials, bags and syringes.

All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

Example 1: Materials and Methods

Lentivirus Production:

pReceiver-Lv156 (GeneCopoeia) was used as the lentiviral vector to express the genes of interest under the EF1α promoter. Lentiviral particles were produced using a series of products developed by TakaraBio (www.takarabio.com). Packaging of viruses was performed using a fourth-generation lentivirus packaging system consisting of the Lenti-X 293T Cells (Takarabio, Cat. #632180) and Lenti-X Packaging Single Shots (Takarabio, Cat. #631275 & 631276). Viral concentration and quantity were determined using the Lenti-X™ Concentrator (Takarabio, Cat. #631231 & 631232) and the Lenti-X qRT-PCR Titration Kit (Takarabio, Cat. #631235), respectively. Lenti-X™ Concentrator is a reagent that is mixed with virus to make a concentrated virus stock after centrifugation prior to using the Lenti-X qRT-PCR kit to determine the actual copy number lentiviral genome (quantity) from which the concentration is calculated. All procedures were performed using manufacturer recommended protocols. Viruses were aliquoted and stored at −80° C. until use.

Stem Cell Culture:

Human iPSC were maintained in StemFit Basic03 medium (Ajinomoto) on a 6 well plate coated with iMatrix 511 (Takara T304). Cells were cultured under conditions of 20% $O_2$/5% $CO_2$ and passaged every 4-7 days by dissociating with TrypLE-Select Enzyme (1×) (Thermo Fisher Scientific 12563011) into single cells.

Corneal Endothelial Cell (CEC) Differentiation Protocol:

The pluripotent stem cell derived corneal endothelial cells were derived from culture dishes in three steps. In the first step, human iPSC were harvested using TrypLE-Select Enzyme (1×) (Thermo Fisher Scientific 12563011) and plated in iMatrix511-pre-coated 6 well plates at a density of $2\times10^5$ cells/well. Cells were cultured using StemFit Basic03 medium supplemented with 10 μM Y27632 for 24h, followed by an additional 2 days of culture in StemFit Basic03 medium without Y27632. In the second step, neural crest cells were induced by culture in a medium comprised of DMEM/F-12 (Thermo Fisher Scientific 11330-032), 20% KnockOut™ Serum Replacement (Thermo Fisher Scientific 10828-028), 1% MEM Non-Essential Amino Acids Solution (Thermo Fisher Scientific 11140-050), 1% L-Glutamine (Thermo Fisher Scientific 25030-081), 6 ng/ml Recombinant Human FGF-basic (Peprotech 100-18B), 0.007% 2-Mercaptoethanol, 1 mM SB431542 (Stemgent 04-0010-10), 0.5 μg/ml Recombinant Human Noggin (Peprotech 120-10C-100UG), and 1% Penicillin-Streptomycin (Thermo Fisher Scientific 15140-122). The medium was replenished every other day for the duration of 6 days. In the third step, cells were cultured for 24 h in a maturation medium comprised of Opti-MEM I Reduced-Serum Medium (Thermo Fisher Scientific 31985-070), 8% Fetal Bovine Serum (Hyclone SH30070.03), 200 mg/L calcium chloride (Sigma-Aldrich C5670-100G), 0.08% chondroitin sulfate A (Sigma-Aldrich C9819-5G), 10% Bovine Pituitary Extract (Alfa Aesar J64417), 5 ng/ml epidermal growth factor (Sigma-Aldrich E9644-.2MG), 20 μg/ml ascorbic acid (Sigma-Aldrich A4403-100MG), 10 μM Y27632, and 1% Penicillin-Streptomycin (Thermo Fisher Scientific 15140-122). The cells were passaged at a 1:9 ratio by treatment with Collagenase type IV (Stem Cell Technologies 07909) in the same medium. 24 h after passaging, the medium was replaced with a medium comprised of Opti-MEM I Reduced-Serum Medium (Thermo Fisher Scientific 31985-070), ITS supplement (Sigma-Aldrich I3146), 200 mg/L calcium chloride (Sigma-Aldrich C5670-100G), 0.08% chondroitin sulfate A (Sigma-Aldrich C9819-5G), 5 ng/ml epidermal growth factor (Sigma-Aldrich E9644-.2MG), 20 μg/ml NGF (Peprotech 450-01), 20 μg/ml ascorbic acid (Sigma-Aldrich A4403-100MG), and 1% Penicillin-Streptomycin (Thermo Fisher Scientific 15140-122) (Maturation Medium 3). The medium was replaced every other day for the duration of 21 days to form iPSC-derived CEC. FIG. 1 is a schematic view of the differentiation protocol. Lentiviral infection of corneal endothelial progenitors was performed at d10 followed by obtaining samples for qPCR analysis at different time points as described herein and, for example, at FIG. 1. The cells at D10 are post inducement of neural crest cell differentiation. Without being bound to theory, it is believed that transduction is not limited to being performed at d10. As such, transduction may be performed at alternate time points. As a non-limiting example, transduction may be performed at a time point between D7 and D20, for example D7, D8, D9, D10, D11, D12, D13, D14, D15, D16, D17, D18, D19 and D20, or between D7 and D18 or between D7 and D17 or between D7 and D16 or between D7 and D15 or between D7 and D14 or between D7 and D13 or between D7 and D12 or between D7 and D11 or between D7 and D10 or between D7 and D9, or prior to D7, for example, DO, D1, D2, D3, D4, D5 or D6, to successfully drive CEC differentiation and maturation.

Transductions of iPSC-Derived Corneal Endothelial Progenitors:

Transduction of iPSC-derived corneal endothelial progenitors with lentivirus particles encoding the transcription factors was performed at d10 of the differentiation process in the presence of polybrene (6 μg/μl) in maturation medium 3. Two days after transduction, the culture medium was replaced with medium with or without puromycin (0.5 μg/μl). The medium was replaced every other day until the collection of cell lysate for total RNA isolation.

Real Time PCR Analysis of Mature Corneal Endothelial Cell Markers:

Total RNA from iPSC-derived CEC was isolated using the RNeasy Micro kit (Qiagen, Cat. #74004), and cDNA was generated with SuperScript VILO cDNA Synthesis Kit (Thermo Fisher Scientific 11754050). Real-time quantitative PCR reactions were performed on a QuantStudio 7 Flex machine (ThermoFisher) using Taqman probes (Table 7) and TaqMan Fast Advanced Master Mix (Thermo Fisher Scientific A44360). Expression level was calculated by delta Ct method normalized to Pgk1 ($2^{-\Delta Ct}$).

TABLE 7

| Gene | Marker | TaqMan ID |
|---|---|---|
| SLC4A11 | mature CEC | Hs00984689_g1 |
| COL8A1 | Immature/mature CEC (expressed on both immature and mature CEC | Hs00156669_m1 |
| PITX2 | TF in anterior segment development, (expressed from POM stage to mature CEC) | Hs04234069_Mh |
| FOXC1 | TF in anterior segment development, (expressed from POM stage to mature CEC) | Hs00559473_s1 |
| TFAP2B | TF in anterior segment development, (expressed from POM stage to mature CEC) | Hs01560931_m1 |
| LMX1B | TF in anterior segment development, (expressed from POM stage to mature CEC) | Hs00158750_m1 |

Periocular Mesenchyme (POM) is a subpopulation of neural crest cells that are positive for Pitx2 and FoxC1.

Example 2: Identification of Transcription Factor Isoforms Enriched in Primary Human CEC In order to identify specific isoforms of transcription factors enriched in primary human CEC, bulk RNAseq data generated by transcriptosome analysis were downloaded from the Gene Expression Omnibus (GEO) database repository of high throughput gene expression data (GSE41416) and analyzed. FastQ files were aligned against human genome hg19 on DolphinNext server. The alignments and the tabulation of reads were performed using a bioinformatics protocol using the STAR-RSEM pipeline. The STAR mapper can align reads onto a reference genome and RSEM can quantify expression levels of genes and transcripts. Expected sequence counts for each isoform as well as transcripts per million (tpm) were obtained and the isoform levels were obtained. The samples were then requested to be interrogated with respect to expression levels of transcription factors.

In a second analysis run using EBSeq software, isoforms were analyzed after grouping all adult samples and all fetal samples into "Adult" and "Fetal" groups respectively and after normalizing for depth of sequencing. FIG. 5 provides all known isoforms for particular transcription factors of the invention enriched in primary human CEC (bulk RNAseq). The length of the pale blue bar in each cell indicates expression level.

Figure 2:
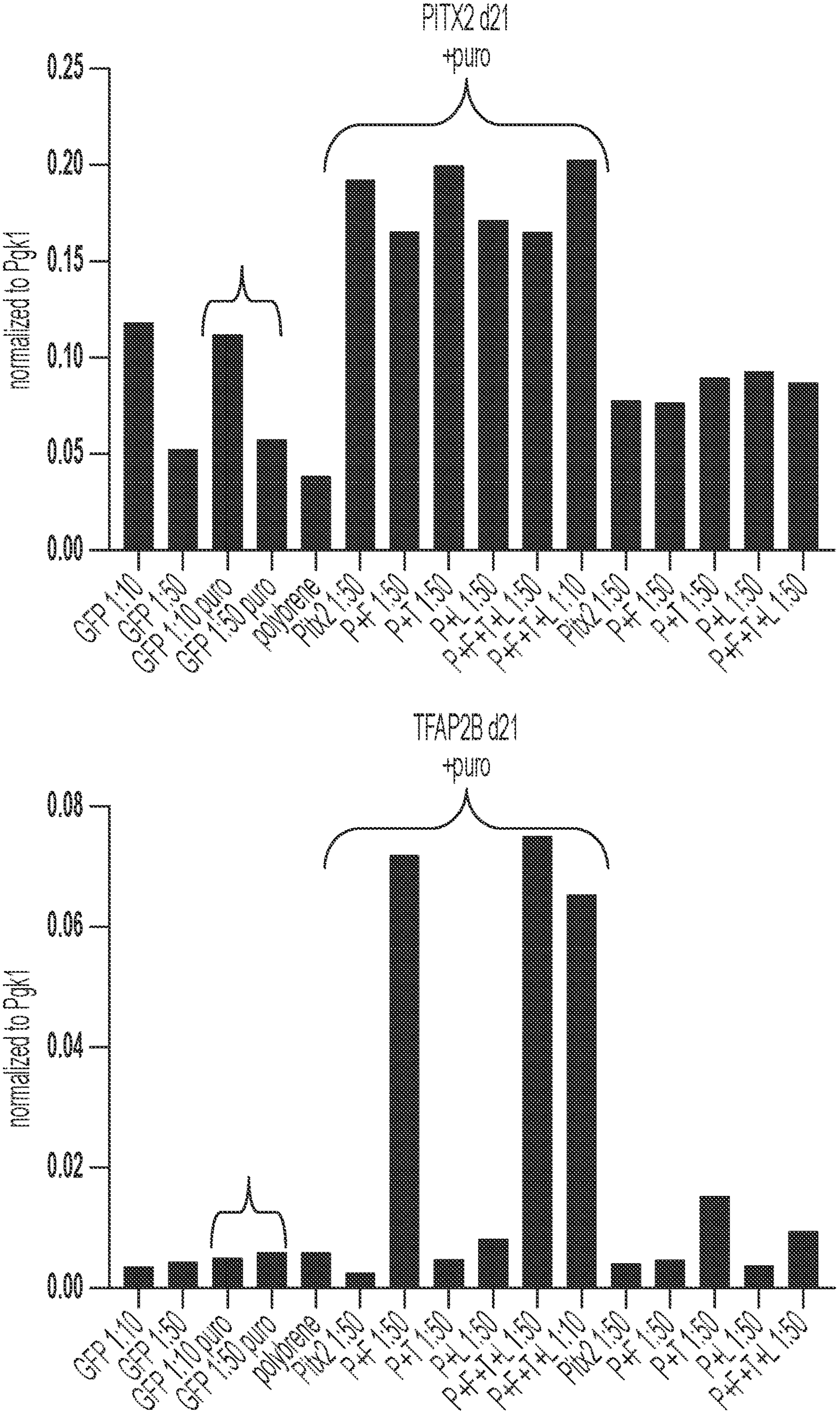
FIG. 2 is a panel of bar-graphs showing the expression level of transcription factors (PITX2, FOXC1, TFAP2B and LMX1B) at day 21 following introduction of these transcription factors into iPSC-derived corneal endothelial progenitors by transduction with lentiviruses expressing the transcription factor. Transduction was performed at day 10 of iPSC-derived CEC differentiation and qPCR analysis was performed at day 21 of differentiation. Infection was achieved using either a 1:10 or 1:50 volume ratio of vector to culture medium. The level of expression of the transcription factors in transduced cells was increased as compared to control cells that were treated with green fluorescent protein (GFP) or polybrene.
Figure 2:
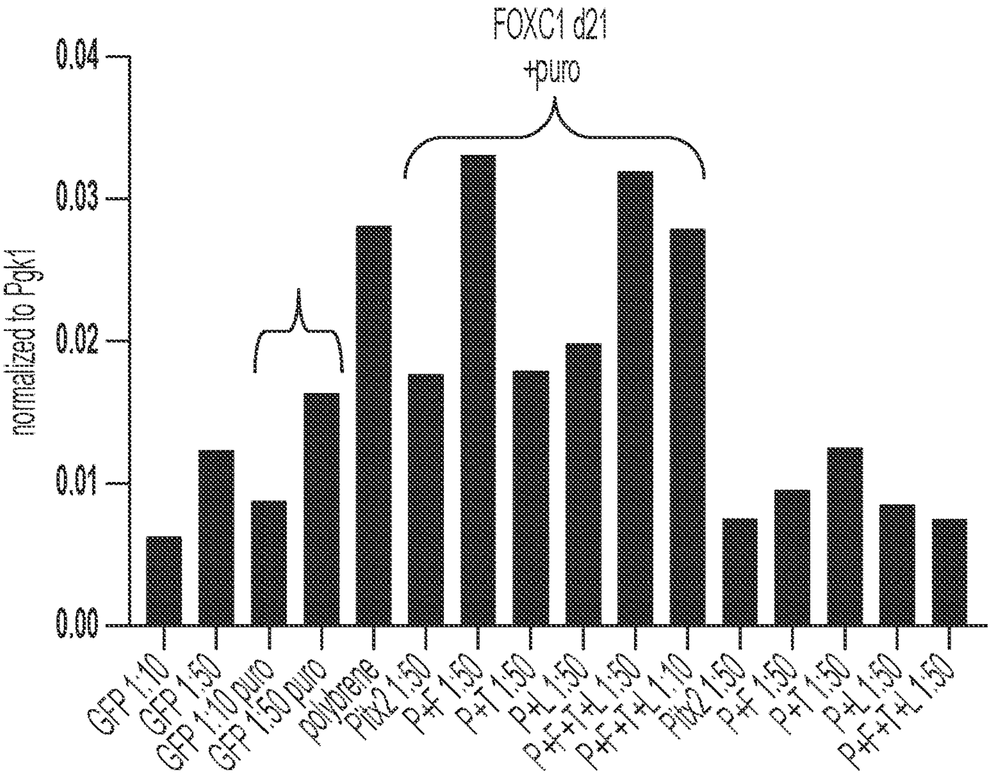
Figure 2:
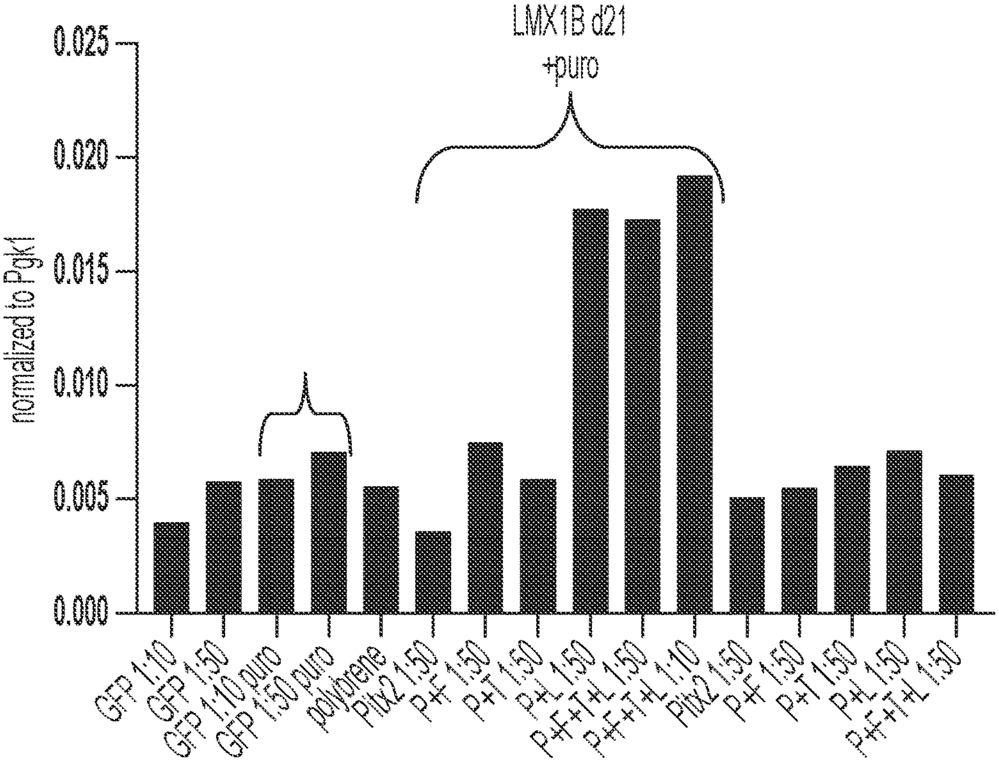

Example 3: Expression of Introduced Transcription Factors in Differentiating iPSC-Derived CEC iPSC-CECs, generated as described above in Example 1, were transduced with lentiviruses (added at either a 1:10 or 1:50 volume ratio to the medium) for selected transcription factor isoforms at d10 of differentiation. PITX2 (P): NM_001204398 and/or NM_000325, FOXC1 (F): NM_001453, TFAP2B (T): NM_003221, LMX1B (L): NM_002316. Puromycin (Puro) selection was performed from d12 of differentiation (2 days after transduction). qPCR analyses were typically performed at d21 of iPSC-derived CEC differentiation; however, analysis could be performed from about d14 to about d28, for example, d14, d15, d16, d17, d18, d19, d20 or d21. Introduced transcription factors (PITX2, FOXC1, TFAP2B, LMX1B) were upregulated compared to control cells treated with GFP and polybrene in the absence of added transcription factor. The upregulation was more prominent in the presence of puromycin (see FIG. 2).

Figure 3:
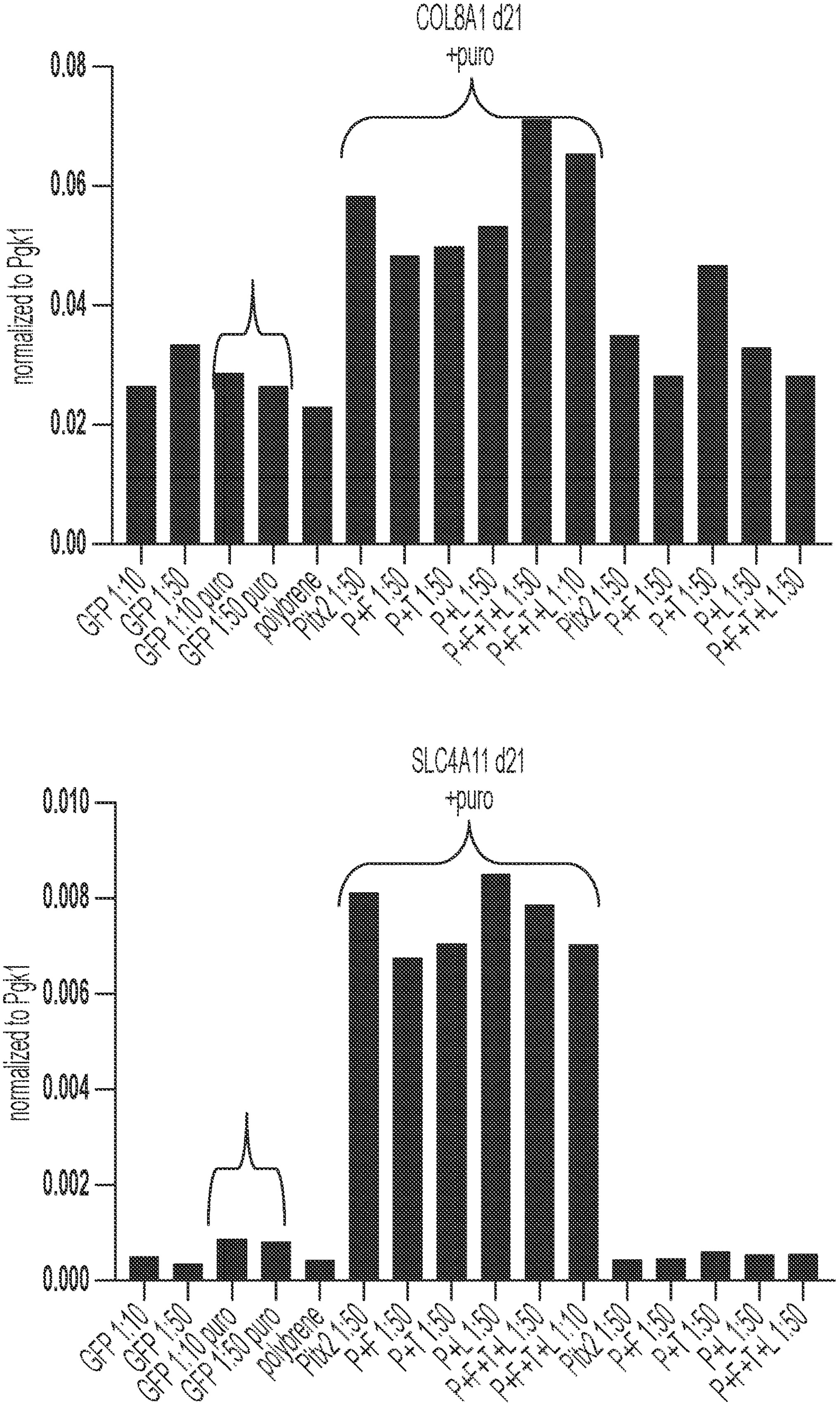
FIG. 3 is a panel of bar-graphs showing the expression levels of COL8A1, a marker of immature to mature CEC, and Slc4a11, a marker of mature CEC, during CEC differentiation of corneal endothelial progenitors transduced with lentivirus expressing PITX2, FOXC1, TFAP2B and LMX1B, either alone or in various combinations. Infection was achieved using either a 1:10 or 1:50 volume ratio of vector to culture medium. qPCR analysis was performed at day 21 of iPSC-derived CEC differentiation. Immature to mature (COL8A1) and mature (SLC4A11) CEC markers were upregulated compared with cells treated with GFP or polybrene only. The increase in expression was greater in the presence of puromycin.
Figure 4A:
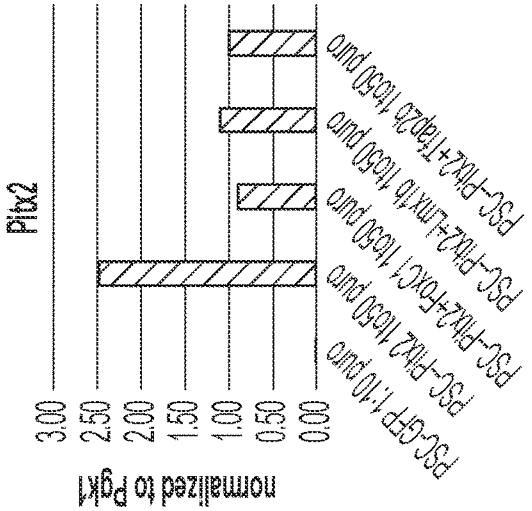
FIG. 4 is a panel of bar-graphs showing the expression of transcription factors PITX2 (A), FOXC1 (B) and TFAP2B (C) in hPSC lines stably infected with vectors expressing the transcription factors. Transcription factors were introduced alone or in combination with other transcription factors. Infection was achieved using either a 1:10 or 1:50 volume ratio of vector to culture medium followed by puromycin selection. Bar graphs D and E show the expression of immature to mature CEC marker COL8A1 (D) and mature CEC marker SLC4A11 (E) upon increasing expression of different transcription factors in the stably infected hPSC lines. Expression was determined by qPCR analysis. The level of expression of COL8A1 (D) and mature CEC marker SLC4A11 was increased in cells engineered to express one or more transcription factors as compared to control cells treated with GFP alone.
Figure 4B:
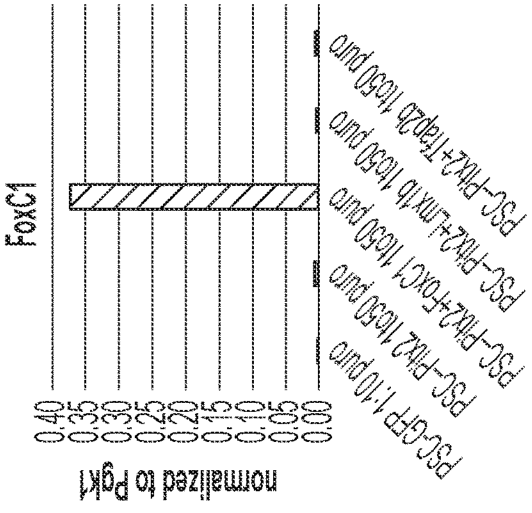
Figure 4C:
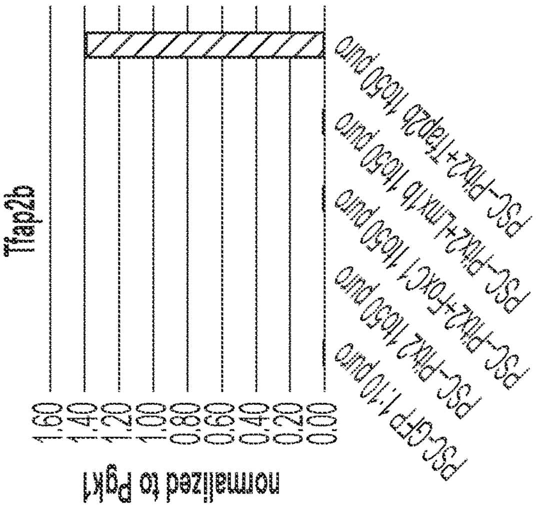
Figure 4D:
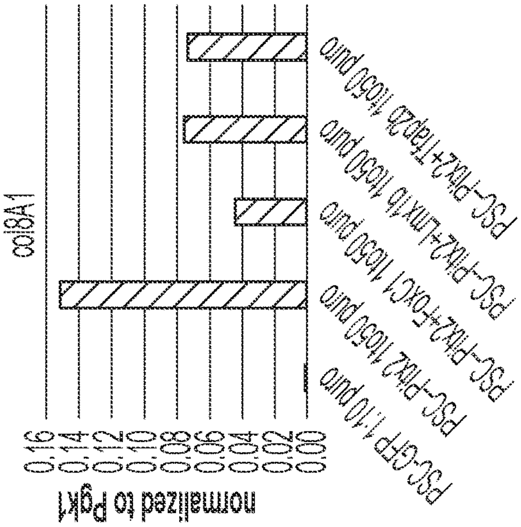
Figure 4E:
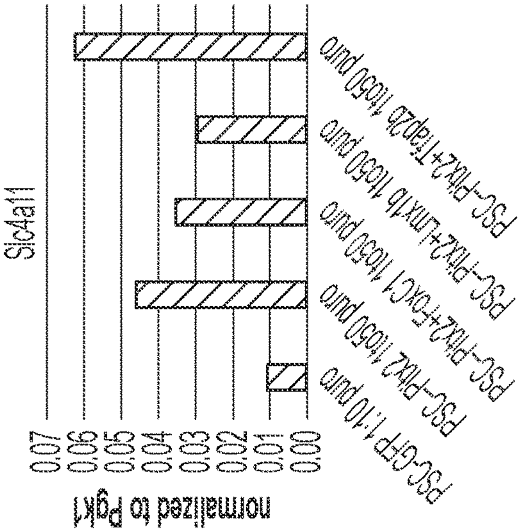

Example 4: Induction of Mid/Late CEC Markers after Transcription Factor Introduction iPSC-derived corneal endothelial cells generated as described above in Example 1, were transduced with lentiviruses as described in Example 1 for selected transcription factor isoforms at d10 of differentiation. qPCR analyses were performed at d21 of iPSC-derived CEC differentiation; however, analysis could be performed from about d14 to about d28. Col8a1, a marker present on immature (for example corneal endothelial progenitors) and mature CEC, and Slc4a11, a marker of mature CEC were upregulated compared with control cells treated with GFP and polybrene in the absence of added transcription factor with increased upregulation occurring in the presence of puromycin (FIG. 3). Comparable upregulation was observed regardless of the combination of transcription factors. PITX2 was the only transcription factor included in all transcription factor combinations tested, suggesting that PITX2 is a critical transcription factor for upregulating mid to late stage CEC markers, such as Col8a1 and Slc4a11 to promote CEC maturation.

Example 5: Functional and Morphological Analysis of Pluripotent Stem Cell Derived Corneal Endothelial Cells Comprising Increased Expression of Transcription Factors Pluripotent stem cell derived corneal endothelial progenitors are generated using a differentiation process, as described in detail in Example 1. Pluripotent stem cell-derived CEC are transduced with lentivirus particles as described in Example 1 at day 10 of differentiation towards mature CEC. The cells are subsequently cultured for 10 days in maturation media, as described above in Example 1. The cells are harvested at day 14 and day 21 and optionally day 28 of cell culture. Functional activity assays for pump function, barrier function and resistance to oxidative stress are performed according to methods known in the art as described herein.

The pump function of CEC (e.g., mature CEC) can be evaluated by methods known in the art, for example, as described in Mimuara et al., 2004 Investigative Opthamology and Visual Science, 45:9, pp. 2992-2997. To determine a change in pump function in mature CEC derived from pluripotent stem cells or corneal endothelial progenitors each of which express a transcription factor of the invention, pump function is compared to cultured primary CEC (e.g., human), unmodified corneal endothelial progenitors, and/or undifferentiated cells (pluripotent stem cells, neural crest stem cells etc.). Addition of ouabain (Na/K ATPase inhibitor) will eliminate the pump function, and allows for evaluation of the presence/absence of pump function.

Mature CEC can also be characterized by the level of resistance to oxidative stress. The level of oxidative stress and/or DNA damage may be detected by measuring the quantity of one or more of: nuclear DNA damage foci; level of expression of p21Cip1, level of expression of p16INK4a; level of expression of cytoglobin protein, level of expression of GPX-1 protein, and level of 8-hydroxy-2-deoxyguanosine (8-OHdG).

Resistance to oxidative stress is also measured by qPCR to determine the level of expression of oxidative stress pathway genes (NRF2, NOS2 etc.) and by measuring Reactive Oxygen Species (ROS) level in the cells using ROS biomarkers such as nitrotyrosine and CellRox (CellROX™ Reagent Variety Pack, for oxidative stress detection, Thermofisher C1044). Response to oxidative stress is evaluated by methods know in the art, for example as described in Guha et al. 2017, Nature Scientific Reports, 4:4074 (DOI: 10.1038/s41598-017-03654-4). To determine a change in resistance to oxidative stress in CEC (e.g., mature CEC) derived from pluripotent stem cells or corneal endothelial progenitors each of which express a transcription factor of the invention, the level of resistance to oxidative stress is compared to cultured primary CEC (e.g., human), unmodified corneal endothelial progenitors, and/or undifferentiated cells (pluripotent stem cells, neural crest stem cells etc.).

Figure 6:
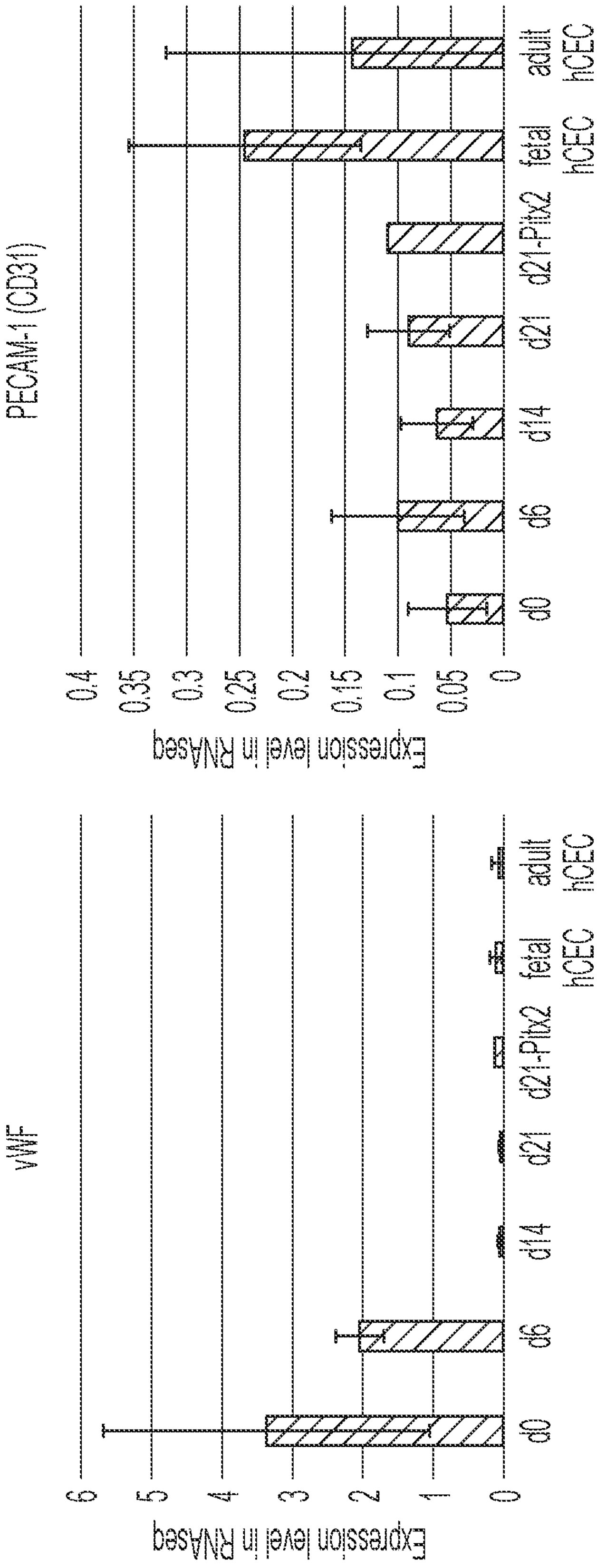
FIG. 6 is a panel of bar-graphs showing the RNA expression levels of vascular endothelial markers vWF and CD31 within CEC cells generated according to methods as described herein.

Further, analysis by qPCR and immunostaining is performed to determine if CEC (e.g., mature CEC) express markers indicative of corneal endothelial cells, including the Na+K+ ATPase pump, ZO-1, and KLF13. Further, CEC that have been generated using the methods as described in Example 1 may be analysed for expression of the vascular endothelial cell markers vWF and PECAM-1 (CD31) (assayed by qPCR and immunostaining), in order to distinguish the CEC cells from vascular endothelial cells. As shown in FIG. 6, RNA of vWF and CD31 were present in only marginal amounts.

CEC that have been generated using the methods as described in Example 1 and hereinabove, are analyzed by observation using phase contrast microscopy for the characteristic CEC morphology—a hexagonal or polygonal shape and tight adherence to one another.

Example 6: In Vivo Efficacy of Mature CEC

The example describes experiments to establish the in vivo efficacy of transplanted PSC-derived mature corneal endothelial cells. Clinical grade mature pluripotent stem cell-derived corneal endothelial cells are generated at a GMP-compliant clinical production facility. Mature CEC are subjected to strict validation and quality controls prior to final release of the mature CEC suspension for transplantation. Each lot of mature CEC undergoes a battery of quality control safety testing including testing for sterility, presence of mycoplasma, presence of endotoxins, absence of pluripotent stem cells, and karyotyping. Identity is confirmed by DNA fingerprinting, appropriate endothelial morphology, and marker expression consistent with CEC. Purity is determined by immunohistochemical staining for the acceptable levels and distribution of mature CEC markers including specific proteins including Na+K+ ATPase pump, ZO-1, and KLF13. In addition, each lot is characterized by qRT-PCR to demonstrate downregulation of hESC markers (OCT-4, NANOG, and SOX2) and upregulation of mature cell marker genes e.g., PITX2, SLC4A11, FOXC1, COL8A1, COL8A2, TFAP2B, LMX1B and MRGPRX3 in accordance with validated specifications.

Mature corneal endothelial cells produced according to the methods described herein are used in non-human animal models, for example to establish potential safety and/or efficacy for human use. Pharmaceutical compositions of cells are used in non-human animal models that assess CEC function. Suitable animal models include a rabbit CEC scraping model (Okumura et al., Am. J. Pathol., 2012, 181(1): 268-277) or a monkey CEC scraping model (Okumura et al, 2016, Scientific Reports, 6:26113, DOI: 10.1038/srep26113). Additional models useful for the invention include rodent models such as L450W and Q455K Col8a2 knock in mouse models of Fuchs Endothelial Corneal Dystrophy (Meng et al., 2013, Invest. Opthamol. Vis. Sci. 54(3):1887-189) and a mouse SLC4A11 knock out model (Groger et al. 2010, J. Biol. Chem., 285(19): 14467).

Cells (e.g., as a sheets or suspension) may be surgically administered to the eye of a non-human animal. Cells may also be in the form of spheroids and administered as spheroids. For example, mature CEC compositions may be used in rabbit models as described in one or more of Honda et al., Arch Ophthalmol. 2009 October; 127(10):1321-6; Hitani et al., Mol Vis. 2008 Jan. 3; 14:1-9; Mimura et al., (Invest Ophthalmol Vis Sci. 2005; 46:3637-3644; Hsuie et al., Transplantation 2006; 81: 473-476; Lai et al., Transplantation 2007; 84: 1222-1232; Shimmura et al., Br J Ophthalmol 2005; 89:134-137; Chen et al., Molecular Vision 2011; 17:2148-2156; and Gospodrowicz et al., Proc. Natl. Acad. Sci. USA, Vol. 76, No. 1, pp. 464-468, January 1979; and/or may be used in rodent (e.g., mouse/rat) models as described above and in Hayashi et al., Investigative Ophthalmology & Visual Science, July 2009, Vol. 50, No. 7, pg. 3151-3158; Mimura et al., Experimental Eye Research 79 (2004) 231-237; Tchah, J Korean Med Sci. 1992 December; 7(4):337-42; and/or may be used in non-human primate models as described in Koizumi et al., Invest Ophthalmol Vis Sci. 2007; 48:4519-4526); Koizumi et al., Cornea 2008; 27(Suppl. 1):S48-S55; and/or in a human or non-human as described in Peh et al., Transplantation. 2011 Apr. 27; 91(8):811-9. Each foregoing publication is incorporated by reference herein in its entirety.

In vivo efficacy of surgically administered mature human CEC that have been transduced to express a detectable marker protein, for example GFP are assessed for engraftment onto recipient cornea for example by confirming GFP expression and immunostaining for human nuclei marker. Donor mature CECs are assessed for functional markers of tight junction formation, for example ZO-1, following engraftment. Corneal thickness following administration of mature CEC can be assessed by methods known in the art e.g. using an ultrasound pachymeter (SP-3000; Tomey, Nagoya, Japan) (see Xia et al. Investigative Opthamology and Visual Science). Pump function can be assessed by detection of markers of pump function, e.g., SLC4A11, NA+/K+ ATPase and SLC4A4. Additional markers associated with pump function that may be expressed in corneal endothelial cells (e.g., mature corneal endothelial cells) include Na+/K+ ATPase, AQP1, CA2, CA4, CA12, SCL14A2, SLC16A1, SLC16A3, SLC16A7, CFTR, NHE1, ADCY10, voltage-dependent anion channels VDAC2 and VDAC3, chloride channel proteins CLCN2 and CLC). The pump function of CEC (e.g., mature CEC) can also be evaluated by methods known in the art, for example, as described in Mimuara et al., 2004 Investigative Opthamology and Visual Science, 45:9, pp. 2992-2997.

Mature corneal endothelial cells produced according to the methods described herein are used for patient therapy, for example, as follows: (i) patients initially receive an immunosuppressive treatment (e.g., steroids); (ii) patients are optionally assigned to a treatment cohort (e.g., four cohorts of three patients each); (iii) escalating doses of cells are administered to the cohorts (preferably unilaterally, i.e., to one of each patient's eyes). Each patient's clinical course is monitored post-transplant, e.g., over the first 6 weeks post-transplant, and optionally at further (prior or subsequent) timepoints, preferably for at least one year. Primary evaluation of patients includes monitoring for adverse events (AE) and dose-limiting toxicities (DTL) including assays for detection of immune-mediated pathology, teratoma formation, and/or abnormal blood vessel growth. Patients are additionally assessed for secondary endpoints including efficacy with regard to intraocular pressure (IOP), visual acuity, and/or endothelial cell count of the graft. Long term follow-up preferably continues for up to 15 years or more to evaluate long term affects. As satisfactory safety data are obtained from the initial patient cohorts, unilateral or bilateral treatment of additional patients is undertaken. Additionally, patients in the initial unilateral cohorts may be offered the opportunity to receive therapy in the previously untreated cornea.

SEQUENCE LISTING (185 sequences)

SEQ ID NO: 1 - DNA, 3110 bp, Homo sapiens
gcagtctgtgtaagttttcatatctctgagtgtgtgcacacagtggagagggtggagcctgccatcctcaaatctgaaaagattgagagatttcagagggcccagatgtgccaaaggtcagagggatcaatatacaggccctaccacggaaaggcggggaaaaggttcgaatagaaaactgctgcagaagggaagccactgagaggagcaaatgtggacttgagggaaactctctcccccacccccacttctatcccgtgcaatttaataccatcctcgccaggaaccttaacctcgtcattttaaaaaatgagatatccgtgacccagggtgaacttgttgaatgtaggtacagcagaggaaattctagactctatgagcgtctgagccttgtccagtgcaaacccttcgtgaacactgggtcagtgcgtggccgtgcccacctgtgcgccgacactctcagcatgcctggtccacccgccttgacctcgggcgcggtgtcccagctaagctgggcccagcgtcccggccttccccagctgacaagcctagctcgttcgctcccggctgtggccctcccaccctctcccactagctcactccattcttctagatttctcttcactcatcctctcccatccccaccgcgcccacctccactcccgccctctaccggtctctcactttcctccctccgcagtccctctttgctgtgacctctttcctcaactctgcaggcctgaaagaaggtcacacacgcacgctcacacccacactccacacgcctcgtcccaaacaaccccatgaacattgtcctttgttccgtctcttgggccactttccctgtcgcttcctcccagcccgtcctgatttgctccccaaaagtacgtttctgtctccccgctgccctggcgctccccctttgatttattagggctgccgggttggcgcagattgctttttcttctcttccatcccatcctcccttctggtcctcctttccacagtgggagtccgtgctcctgctcctcggttggctcctaagtgccccgccaggtcccctctcctttcgctctcccggctccggctcccgactcttcggcccgctggcatctgcttccctcccctgcctcgtttctcgtcgcccctgctcgctccccccggcgctcgcccgggcgctgtgctcgctcctggatcgccagccgcgcagccgggctcggccggccgcccgcgcgccactgtgcagtggagtttggtggaatctctgctgacgtcacgtcactccccacacggagtaggagcagagggaagagagagggatgagagggagggagaggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccgataacggggaatggagaccaactgccgcaaactggtgtcggcgtgtgtgcaattagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaaaaa

SEQ ID NO: 2 - DNA, 3482 bp, Homo sapiens
gcagtctgtgtaagttttcatatctctgagtgtgtgcacacagtggagagggtggagcctgccatcctcaaatctgaaaagattgagagatttcagagggcccagatgtgccaaaggtcagagggatcaatatacaggccctaccacggaaaggcggggaaaaggttcgaatagaaaactgctgcagaagggaagccactgagaggagcaaatgtggacttgagggaaactctctcccccacccccacttctatcccgtgcaatttaataccatcctcgccaggaaccttaacctcgtcattttaaaaaatgagatatccgtgacccagggtgaacttgttgaatgtaggtacagcagaggaaattctagactctatgagcgtctgagccttgtccagtgcaaacccttcgtgaacactgggtcagtgcgtggccgtgcccacctgtgcgccgacactctcagcatgcctggtccacccgccttgacctcgggcgcggtgtcccagctaagctgggcccagcgtcccggccttccccagctgacaagcctagctcgttcgctcccggctgtggccctcccaccctctcccactagctcactccattcttctagatttctcttcactcatcctctcccatccccaccgcgcccacctccactcccgccctctaccggtctctcactttcctccctccgcagtccctctttgctgtgacctctttcctcaactctgcaggcctgaaagaaggtcacacacgcacgctcacacccacactccacacgcctcgtcccaaacaaccccatgaacattgtcctttgttccgtctcttgggccactttccctgtcgcttcctcccagcccgtcctgatttgctccccaaaagtacgtttctgtctccccgctgccctggcgctccccctttgatttattagggctgccgggttggcgcagattgctttttcttctcttccatcccatcctcccttctggtcctcctttccacagtgggagtccgtgctcctgctcctcggttggctcctaagtgccccgccaggtcccctctcctttcgctctcccggctccggctcccgactcttcggcccgctggcatctgcttccctcccctgcctcgtttctcgtcgcccctgctcgctccccccggcgctcgcccgggcgctgtgctcgctcctggatcgccagccgcgcagccgggctcggccggccgcccgcgcgccactgtgcagtggagtttggtggaatctctgctgacgtcacgtcactccccacacggagtaggagcagagggaagagagagggatgagagggagggagaggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccgaatcactaaatctggagccgccaaactgctacttctgggcccacgggcccacaaggatcgaatcggcagagtccccgcccgcgttctcgctagcgggtgggggaaccgcctggccgtccccaccctggatccccacgccacagcgccgggcagcccctcctgtaggcagcgaccttggccagaggctccccagggcccagctcccttcaggagaggccgagacgcagggaaacgataacggggaatggagaccaactgccgcaaactggtgtcggcgtgtgtgcaattaggcgtgcagccggcggccgttgaatgtctcttctccaaagactccgaaatcaaaaaggtcgagttcacggactctcctgagagccgaaaagaggcagccagcagcaagttcttcccgcggcagcatcctggcgccaatgagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaaaaa

SEQ ID NO: 3 - DNA, 1874 bp, Homo sapiens
gcagtctgtgtaagttttcatatctctgagtgtgtgcacacagtggagagggtggagcctgccatcctcaaatctgaaaagattgagagatttcagagggcccagatgtgccaaaggtcagagggatcaatatacaggccctaccacggaaaggcggggaaaaggttcgaatagaaaactgctgcagaagggaagccactgagagataacggggaatggagaccaactgccgcaaactggtgtcggcgtgtgtgcaattaggcgtgcagccggcggccgttgaatgtctcttctccaaagactccgaaatcaaaaaggtcgagttcacggactctcctgagagccgaaaagaggcagccagcagcaagttcttcccgcggcagcatcctggcgccaatgagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaaaaa

SEQ ID NO: 4 - DNA, 1736 bp, Homo sapiens
gcagtctgtgtaagttttcatatctctgagtgtgtgcacacagtggagagggtggagcctgccatcctcaaatctgaaaagattgagagatttcagagggcccagatgtgccaaaggtcagagggatcaatatacaggccctaccacggaaaggcggggaaaaggttcgaatagaaaactgctgcagaagggaagccactgagagataacggggaatggagaccaactgccgcaaactggtgtcggcgtgtgtgcaattagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaaaaa

SEQ ID NO: 5 - DNA, 2294 bp, Homo sapiens
ggagccgcagatctggtccgtcgctcgcctgggtgcctggagctgagctgcggcaaggcccggctcctgttcgaccgcccgaggggtgtgcgtgtgcgcgttgcggagggtgcgctcagagggccgcgtcgtggctgcagcggctgctgccgccgcaggggatctaatatcacctacctgtccctgtcactcttgacacttctctgtcagggctgccgcgtggggggggggcgggcagagcgcggtcggcgttagctttccttattggaggggttcttgggggagggagggagagaagaagggggtctttgcccactcttgtttcgctttggagcttggaagcctgctccctaaagacgctctgagtggtgcccttctgcccacatcccatgtcttcgtttgcccgctgactttccgtctccggactttttcgcttgagccttccggaggagacgggggcagcttggcttgagaactcggcgggggttgcgtcccctggctctccccgcagcggggaaactccgcgcctagagcgcgacccggagcgggcagcggcggctacgggggctcggcggggcagtagccaaggactagtagagcgtcgcgctccctcgtccatgaactgcatgaaaggcccgcttcacttggagcaccgagcagcggggaccaagctgtcggccgtctcctcatcttcctgtcaccatccccagccgttagccatggcttcggttctggctcccggtcagccccggtcgctggactcctccaagcacaggctggaggtgcacaccatctccgacacctccagcccggaggccgcagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaa

SEQ ID NO: 6 - DNA, 3248 bp, Homo sapiens
gcagtctgtgtaagttttcatatctctgagtgtgtgcacacagtggagagggtggagcctgccatcctcaaatctgaaaagattgagagatttcagagggcccagatgtgccaaaggtcagagggatcaatatacaggccctaccacggaaaggcggggaaaaggttcgaatagaaaactgctgcagaagggaagccactgagaggagcaaatgtggacttgagggaaactctctcccccacccccacttctatcccgtgcaatttaataccatcctcgccaggaaccttaacctcgtcattttaaaaaatgagatatccgtgacccagggtgaacttgttgaatgtaggtacagcagaggaaattctagactctatgagcgtctgagccttgtccagtgcaaacccttcgtgaacactgggtcagtgcgtggccgtgcccacctgtgcgccgacactctcagcatgcctggtccacccgccttgacctcgggcgcggtgtcccagctaagctgggcccagcgtcccggccttccccagctgacaagcctagctcgttcgctcccggctgtggccctcccaccctctcccactagctcactccattcttctagatttctcttcactcatcctctcccatccccaccgcgcccacctccactcccgccctctaccggtctctcactttcctccctccgcagtccctctttgctgtgacctctttcctcaactctgcaggcctgaaagaaggtcacacacgcacgctcacacccacactccacacgcctcgtcccaaacaaccccatgaacattgtcctttgttccgtctcttgggccactttccctgtcgcttcctcccagcccgtcctgatttgctccccaaaagtacgtttctgtctccccgctgccctggcgctccccctttgatttattagggctgccgggttggcgcagattgctttttcttctcttccatcccatcctcccttctggtcctcctttccacagtgggagtccgtgctcctgctcctcggttggctcctaagtgccccgccaggtcccctctcctttcgctctcccggctccggctcccgactcttcggcccgctggcatctgcttccctcccctgcctcgtttctcgtcgcccctgctcgctccccccggcgctcgcccgggcgctgtgctcgctcctggatcgccagccgcgcagccgggctcggccggccgcccgcgcgccactgtgcagtggagtttggtggaatctctgctgacgtcacgtcactccccacacggagtaggagcagagggaagagagagggatgagagggagggagaggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccgataacggggaatggagaccaactgccgcaaactggtgtcggcgtgtgtgcaattaggcgtgcagccggcggccgttgaatgtctcttctccaaagactccgaaatcaaaaaggtcgagttcacggactctcctgagagccgaaaagaggcagccagcagcaagttcttcccgcggcagcatcctggcgccaatgagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaaaaa

SEQ ID NO: 7 - DNA, 3983 bp, Homo sapiens
gctcaaaagttcagaagttttcccaatgcttccttaagcggctggcgcgcgagagaccgagaaaaggtgacgcggggcccgggcaggcggccggcgcgcggccccccccccccccgccctggttatttggccgccttcgccggcagctcagggcagagtctcctggaaggcgcaggcagtgtggcgagaagggcgcctgcttgttctttctttttgtctgctttcccccgtttgcgcctggaagctgcgccgcgagttcctgcaaggcggtctgccgcggccgggcccggccttctcccctcgcagcgaccccgcctcgcggccgcgcgggccccgaggtagcccgaggcgccggaggagccagccccagcgagcgccgggagaggcggcagcgcagccggacgcacagcgcagcgggccggcaccagctcggccgggcccggactcggactcggcggccggcgcggcgcggcccggcccgagcgagggtggggggcggcgggcggcgcggggcggcggcgagcgggggccatgcaggcgcgctactccgtgtccagccccaactccctgggagtggtgccctacctcggcggcgagcagagctactaccgcgcggcggccgcggcggccgggggcggctacaccgccatgccggcccccatgagcgtgtactcgcaccctgcgcacgccgagcagtacccgggcggcatggcccgcgcctacgggccctacacgccgcagccgcagcccaaggacatggtgaagccgccctatagctacatcgcgctcatcaccatggccatccagaacgccccggacaagaagatcaccctgaacggcatctaccagttcatcatggaccgcttccccttctaccgggacaacaagcagggctggcagaacagcatccgccacaacctctcgctcaacgagtgcttcgtcaaggtgccgcgcgacgacaagaagccgggcaagggcagctactggacgctggacccggactcctacaacatgttcgagaacggcagcttcctgcggcggcggcggcgcttcaagaagaaggacgcggtgaaggacaaggaggagaaggacaggctgcacctcaaggagccgcccccgcccggccgccagcccccgcccgcgccgccggagcaggccgacggcaacgcgcccggtccgcagccgccgcccgtgcgcatccaggacatcaagaccgagaacggtacgtgcccctcgccgccccagcccctgtccccggccgccgccctgggcagcggcagcgccgccgcggtgcccaagatcgagagccccgacagcagcagcagcagcctgtccagcgggagcagccccccgggcagcctgccgtcggcgcggccgctcagcctggacggtgcggattccgcgccgccgccgcccgcgccctccgccccgccgccgcaccatagccagggcttcagcgtggacaacatcatgacgtcgctgcgggggtcgccgcagagcgcggccgcggagctcagctccggccttctggcctcggcggccgcgtcctcgcgcgcggggatcgcacccccgctggcgctcggcgcctactcgcccggccagagctccctctacagctccccctgcagccagacctccagcgcgggcagctcgggcggcggcggcggcggcgcgggggccgcggggggcgcgggcggcgccgggacctaccactgcaacctgcaagccatgagcctgtacgcggccggcgagcgcgggggccacttgcagggcgcgcccgggggcgcgggcggctcggccgtggacgaccccctgcccgactactctctgcctccggtcaccagcagcagctcgtcgtccctgagtcacggcggcggcggcggcggcggcgggggaggccaggaggccggccaccaccctgcggcccaccaaggccgcctcacctcgtggtacctgaaccaggcgggcggagacctgggccacttggcgagcgcggcggcggcggcggcggccgcaggctacccgggccagcagcagaacttccactcggtgcgggagatgttcgagtcacagaggatcggcttgaacaactctccagtgaacgggaatagtagctgtcaaatggccttcccttccagccagtctctgtaccgcacgtccggagctttcgtctacgactgtagcaagttttgacacaccctcaaagccgaactaaatcgaaccccaaagcaggaaaagctaaaggaacccatcaaggcaaaatcgaaactaaaaaaaaaaaatccaattaaaaaaaacccctgagaatattcaccacaccagcgaacagaatatccctccaaaaattcagctcaccagcaccagcacgaagaaaactctattttcttaaccgattaattcagagccacctccactttgccttgtctaaataaacaaacccgtaaactgttttatacagagacagcaaaatcttggtttattaaaggacagtgttactccagataacacgtaagtttcttcttgcttttcagagacctgctttcccctcctcccgtctcccctctcttgccttcttccttgcctctcacctgtaagatattattttatcctatgttgaagggagggggaaagtccccgtttatgaaagtcgctttctttttattcatggacttgttttaaaatgtaaattgcaacatagtaatttatttttaatttgtagttggatgtcgtggaccaaacgccagaaagtgttcccaaaacctgacgttaaattgcctgaaactttaaattgtgctttttttctcattataaaaagggaaactgtattaatcttattctatcctcttttctttctttttgttgaacatattcattgtttgtttattaataaattaccattcagtttgaatgagacctatatgtctggatactttaatagagctttaattattacgaaaaaagatttcagagataaaacactagaagttacctattctccacctaaatctctgaaaaatggagaaaccctctgactagtccatgtcaaattttactaaaagtctttttgtttagatttattttcctgcagcatcttctgcaaaatgtactatatagtcagcttgctttgaggctagtaaaaagatatttttctaaacagattggagttggcatataaacaaatacgttttctcactaatgacagtccatgattcggaaattttaagcccatgaatcagccgcggtcttaccacggtgatgcctgtgtgccgagagatgggactgtgcggccagatatgcacagataaatatttggcttgtgtattccatataaaattgcagtgcatattatacatccctgtgagccagatgctgaatagatattttcctattatttcagtcctttataaaaggaaaaataaaccagtttttaaatgtatgtatataattctcccccatttacaatccttcatgtattacatagaaggattgcttttttaaaaatatactgcgggttggaaagggatatttaatctttgagaaactattttagaaaatatgtttgtagaacaattatttttgaaaaagatttaaagcaataacaagaaggaaggcgagaggagcagaacattttggtctagggtggtttctttttaaaccattttttcttgttaatttacagttaaacctaggggacaatccggattggccctcccccttttgtaaataacccaggaaatgtaataaattcattatcttagggtgatctgccctgccaatcagactttggggagatggcgatttgattacagacgttcgggggggtggggggcttgcagtttgttttggagataatacagtttcctgctatctgccgctcctatctagaggcaacacttaagcagtaattgctgttgcttgttgtcaaaatttgatcattgttaaaggattgctgcaaataaatacactttaatttcagtcaaaaa

SEQ ID NO: 8 - DNA, 5631 bp, Homo sapiens
agacatctgctcctcacatgaatgcactcacctcctagagaccaggctgccatcatgctctggaagcttgtggagaatgtcaagtacgaagatatctatgaggaccggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccagtcagttgaagatgccaataacagcggcatgaatctattggaccagtctgtcattaaaaaagttccagttcctcccaaatcggtgacttctctaatgatgaataaagacggcttcctgggaggcatgtctgtcaacaccggcgaggtgttttgctccgtcccaggccgtttgtctctgctcagttcaacttcgaagtacaaagtaactgtgggagaagttcagagacggctgtcgccccctgaatgcctcaatgcatctctcctcggcggagtcctcagaagagccaaatcgaaaaatggggggagatctttgcgagaaaggctagaaaaaatcggtttgaatttacccgcgggcaggcgcaaagcagcaaatgtcacgttactcacctccctggtggaaggagaagctgttcacttagctagggattttgggtacatttgcgaaacggagtttcccgccaaagccgtctctgagtatttgaaccggcagcacacagacccgagtgacctgcactcccgaaagaatatgctgttggccaccaagcaactttgtaaagaatttacggatctactggcgcaggaccggacaccgatagggaacagccgacccagccccatcctggagccggggatccagagctgcctcacgcacttcagcctcatcacgcacggcttcggcgccccggccatttgcgccgcgctcacggccctgcagaactatctcaccgaggcgctcaaaggcatggacaagatgttcttgaacaacaccaccactaacaggcacacgtctggggaaggcccaggtagtaaaactggcgacaaggaggagaaacacaggaaatgaaaaatttttaaaaaaagaaggaaaaatgttttaaatacaaaaggaaaaacagacaaaaatttaattttagctttaaaatattggattggctttggaagaattatattaggtagaatacacatacaatcaaaattttaaaaaaaaaagctaaataacttaaaaaaaaactgaggcgtacaacggagcaacaatatcggttctcagtgtctatttcaagatacatttggagacaaccgtccggattttccacttcggttctttcgagtttagtaatactgataataaaagaaaaccatgatttccccttccctttggaaaataaacataagactaaacatgagaaaaacgctaacttattggaagaaaatcggagaaacgttggtgtcaatgctttgagagctggttgactgagacgcacgaactttttaattttaaatatatttttaggaaactctcgcagtccccgccctccatctcacctcacccgtctcccaaccacccttttccatgttaccctcccttcctcacattgttacgggaatcttctgggatgaaaatgagtgtggttggcccttttgcgttgtttcagtcctctcggtacctccccgcccagccctgcgatcttaactcaccgggcccggctccccggccgcttgcataattagggagggcgagggcggggcgggaggcctgtggagaccaggcggaggctgcaatttttggtgccggccggcagagcaggttctggcggctgaggaaaatccggaccaataagttgattcaaacatcatcagttcctttcagaaatgttactagctcccagccttgccagcatctgcatagagagaatctcacatttattatatttgtgtcatctactaattttatgaactatagtaaaaaaaaaaaaacacacacacacacaatatgaatacgttgattagtatgtaattccttcggaggggtatgtaccatttcattctcttctgttttccaaagctttgcccgcatggtttatgagcttcttcaaagaggacttgggcttcctacacaatctataaggtacagagaaaaaaaaatccgatccctttttaatcaaagcctgtgtgtcagaattctgcaggtgcacttctttaaagaagctcaaagggaataatttagaaagtggccaatatgatggaagcagctttgaatctacatgctaacattcctcaacactccaattccggtggaggtggcaggggagggggtctgcaaaatgaattttaagggaaaagagtaaggattcttagagccctatattctaatagtattgccctgcatttaaaattgatttgatttccctgggttctttggtgattgctgtttaagcaaggaaagaagcagctttacgagtggacgtggggaggagggcggcacaagcacccacatttctgtaacaattgctttcttacaagatgctttatgaatgaggcatttttccctcccagacgtgcacttgttttggcatataatggcaaaataatgcaaagtgaagggagatgtatttcagctttgatttttaccgtctggatacatcgggactattcccagtggataaagtttcatgcatttaatatttctcacttctggcagcccagctcctttcttgggctccatcttagcattatcatgaaataagatctggaatccattgtctgcacctccgcaaaagcagtgagaaattatcccgggataagggtgaatgagagaggtctctaaatatagtgttgatacactcacctatttaacaaagtagacgagatctttgcaataccccttaaagataacgacatagatgttgttctgcaggatttatagttaggacccactcaattctccaggactcccggttttgcccccctcccgctttgccttggtgggggtggggattgggggagtggggattgcgttggggttttaggaatctgctgagagctttgcccatttttattaaaagaggaaagggaagttaggaagctcgtctcaggtcaccaaaagggcccaagcaactgttagggccacactgcagcccatctccaacccctagcttcgtttagcacttctgatcttcatggcccagccctagaactgttgagaggaatgcaatggccaagagctagacgttacggagagtgtagtcactctcttttcccagctcagaggcctgcgccttcgtccgagagctcggccgatcgcattagatgtgttctgattgcacaaggccaggagagaccacactgaaaacgatcgtctcctttccttgcagggcaacgcgccccacgcgtgtgacgtgcgagagacgcgatggacgcgccttgctcttactgtgcaggtcctgagagcgtgtgggccacaggcgcccagtcgtgttgaggacatagaatcagccgctggaggggctgccgactgcgcgggcccttcccgctctcggtctcaccctaagggctaaggcgaccgagaaagccccattctccagtaggtaatggggcggcgcccggtgggctgcaggtggggagggctcccagcgccgccagcggccacccggggcgccggctcctggagggagagtggcctagaaatatccaaggaatccgaagcttcccctcctccacctctgccagtacggaaacaccccaccgtcacaatcctaaagcggggagatgggatgggaattgtcttacttggcaaggcagggtaccttcattgccagacgccctcatttgtgtgttcctccttgctccagcgagatagaaccttttgcgcccccaaccccgtttcgtggagtgagcccactaccccttctccctccctcacttctcctttcatgtaggacccccgcccccttgctttccttagccaggcccgctacatttatctgataattgagttattaaaagatttggtttccttgggcctataaatcaataaacagtaggattaacgcaatagtttgccttttaagtcaagggagacgtttaaggcaagcccctttgagctttgttttcaaaccaaacaggtgagttgcagctctccccccggcccctgcactcttcagacatttggtccctgcccactcctaaacgctcagtcccaaaacaaaatagcgaaagacaggaggagtcaggatgtggcagtgctgccttcacactttccacttcgcaagttcttttaaaggttccaaagatctccagaccattctctgccaaaccctgccgcctcctgcacgtattgcaggtctctggggagcaagaaatgtcctgtttgggtgaggattccgtcacctaaaaagatctttaacttctcccccaaagtgggaaggtaactttctcccccttttccccaccaccttcactcctacacccccaattaccttgcattttctttccttccttctggcctccacacccatagctttcctccatccccacttaaagaaccgaagaggcttttaaagacctggctgctttgttttccttggccaaggaagccactttctctcaagcaattatttcatatcctacgaaaactttggtcgaatggaaaactcgaaacctcgagcttatctacacactgttcctctgctacaatgctttcctagttaagagtgtttatagagaatttgtcatcacatctgatatcctgtacttgtaatacattatgtggaaaggaaataaccttaaaccgtctgatgttgcctcaagagcccaaacggcgtttccccacctttgacgatgtatgtgaaattactggcttaaaaaaaaaagtatcaatttttttttaacggaatgaacactatccttctttaaatgccaaaatcgactccacctttgagttggtctctaattctctaacattgtttttgccacacaatcaagaaatatcaatctattgactcttcacgagaagagctctggagggtattcatgttaagtttgtatatatttatttatgcttaatttaatgggaatgtgtaaatatggcgagcaagtagtttgggattatttatctgtgaatctatacctctgtgaatgggtggttaaaaaacctcttgaccctagatagaatcctatctgaatttttctgttctttataaacaagctgttatggtaatgggtagaaattggtttattgtccagtgttaatctgatttacataaataaaaagattgttgtgttttcatcttca

SEQ ID NO: 9 - DNA, 6324 bp, Homo sapiens
agccccagctctaaacccggcggctcagcgggcgcaccatggcactggagtagcgcggggagcgcgcccggagccccgcggcccgctgcgccccgcccgggaccccgctgcgccgcgcgccccccccgcggcccgcggggccgcccctgcacccccaccccctcccccgcctgccgccgccgccaccgccaccgccgccgccgcctcctccccgcggctccgtctgcagcagccgccgccgccgggttccgggactgacaagcaggtgacagaggagccggcgcgcgtggctgcaagtgtccgggagagcgcggcgcgggctgcagccgccccggcccgcccgcacgacgccggggcccggggccagcgcgtcgccgctccacgatcgccgggggccggcgcaacccctgccctgcgggggccgcgcctccccggttccagggccgcggcggcggagagcgggtggacgggccggcgggcgagcagcccggccggcggggtccgcagcgcgccccgcgtcccatggatatagcaacaggtcccgagtcgctggagaggtgcttccctcgcgggcagacggactgcgccaagatgttggacggcatcaagatggaggagcacgccctgcgccccgggcccgccactctgggggtgctgctgggctccgactgcccgcatcccgccgtctgcgagggctgccagcggcccatctccgaccgcttcctgatgcgagtcaacgagtcgtcctggcacgaggagtgtttgcagtgcgcggcgtgtcagcaagccctcaccaccagctgctacttccgggatcggaaactgtactgcaaacaagactaccaacagctcttcgcggccaagtgcagcggctgcatggagaagatcgcccccaccgagttcgtgatgcgggcgctggagtgcgtgtaccacctgggctgcttctgctgctgcgtgtgtgaacggcagctacgcaagggcgacgaattcgtgctcaaggagggccagctgctgtgcaagggtgactacgagaaggagaaggacctgctcagctccgtgagccccgacgagtccgactccgtgaagagcgaggatgaagatggggacatgaagccggccaaggggcagggcagtcagagcaagggcagcggggatgacgggaaggacccgcggaggcccaagcgaccccggaccatcctcaccacgcagcagcgaagagccttcaaggcctccttcgaggtctcgtcgaagccttgccgaaaggtccgagagacactggcagctgagacgggcctcagtgtgcgcgtggtccaggtctggtttcagaaccaaagagcaaagatgaagaagctggcgcggcggcaccagcagcagcaggagcagcagaactcccagcggctgggccagggtgagccggggccggggcagggcctgggccaggaggtcctgtccagccgcatggagggcatgatggcttcctacacgccgctggccccaccacagcagcagatcgtggccatggaacagagcccctacggcagcagcgaccccttccagcagggcctcacgccgccccaaatgccagggaacgactccatcttccatgacatcgacagcgatacctccttaaccagcctcagcgactgcttcctcggctcctcagacgtgggctccctgcaggcccgcgtggggaaccccatcgaccggctctactccatgcagagttcctacttcgcctcctgagagccagccaggcgcacggacgcttgggcaggggcctgggggggactgccagcctctgcggccagcctggccacccccgccctgctctccgcacagactacagacagccatacggtgccctcccctcggccagctgggcctgaccactgtgcccgttgggtacagccagaccggtagatgggcacagcctgggcaggggctgtgtcctgcccacagagaccttgtcatccccagggacccagagctctcggacggccactcgcctcccagccccacctcggcctccatcgcctcctccccatctcttttttgggaagcttaaattctctctatttttttaaatgtcctctctgtgtccatggccctccatgcaagccccaggacaatggtgtcatgaggcggtgacctgagaagcgtgtgtacctgtgccccagcaagggcaggggtggcctctgggggcaggcccactgcctggaaccgcacacccctcagcctgagtctggagcagcagtggagaggggcctgaggggaggcactgtcaggaggcgggctcggagcctgagcctgggcaggcgcaaagggacagagaggcacgtgcagacacatgcacacttgcagacaaacccacgcaaacacacacacagctgtatggggacaccagaagggacagggatgctcagcgggtctgtcctgccttgtcagaaagagaaaaggaggccaggcaggggaccccccagttcttaagagcgattggaaagggaggaaggggagaggaagaggcgaacttgaagcatcggacccagttgtatcccagcctgggcccaaatgggggcagcctgggcagggagggcagccccaggccccaccaactctagaggcagatggagcccccagaaccaggtagcatcagaccagacaacagagcctccaggggtcagggacttcagaagcacctgctgggcaccccatctgcaatgtggtcctctccccagccacctctgcctcccctcacatacctccagtgacaaggagctcactaggtcagcgagcccacagcagctgtgctgtcctgcatcccagagccaggcttccccagctctccctcttaacactgtcccccagcaggcctccggctgtccctctaaaggtgtggggcaggtatcacttcaccttcccactgatgtcagccggccagaagtgagcaggcacatcacctctcctgctgtggcacccttcctctgttaatttggcccaaaagacaatgatttggccacatgaccttagagattcaccctgccctgctgtagctaaatccctgggccccacacgcaagtgacagctaagccacatctgttttctgtgtatatgcaggatgggggcacctactgttttgttttgttttgttttgttttgttttgttttgttttgttttgttttgtttgagacggagtttcgctcttgttgcccaggctggagtgcaatggcgcgatctcggctcaccacaacctccgcctcccaggttcaagtgattctgatgcctcagcctccctagtagctgagattacaggcatgcgccaccacacccagctaattttgtatttttagtagcaacggggtttctccatgttggtcaggctggtctccaacccccgacctcaggtgatccgcctgcctcggcctcccaaagtgctgggattacaggcgtgagccaccgcacccagtctgcacttactgtttagactgaatgagggaccgtgacctctttccttttccattccttcttactcgattcattccagcctgtggaatttctctgcaccctgattcagtgaccactgctctcctctctcccagcacatctgcccagtgaggagttggccctgggtctcacctgaggtgtgtggaccgggctggcctctccctgtttgacattggcccattaatgcatcctctttgggggacacattccaattgcatttcctgcccccttctcccagggcaattgcagaagattgtgtcaggcgccctgctggaagtcaggtgcactagatccatccccagccccagtctgctcaactctatccctgtcagagcaaggaggctgggctgctggggcctgactggtgagcccaccctgtcccctggtgatcactgtgtccccttgttcaggtgctcacaaccctacctttaactctgaggtcaagccctaggccaccaccctaaagtctgcctggtccaacctttgagcaagtaaggataatgaatgtcccttttccacctttggggccctctgcctggatctctggaatcctctaagttcaacctgttctgtggttttgctcccgtttgctgggaaattcagtccccccagaatgtcctgggccaacctccttgcctgacatgtggcctcgtgtcacccattgggccccagcagccagctagcccttctgcagctcttcttacaaacagagcctctccaaggacctcagttgatgttctggtccttctgccgcctcagcccaccagggtccgtgccaccatgggtctcttgagcagcagctgcactggcttctggagagacacccctctttctccttttgcacatgcaccatctgaatcgtgccagggacatcctgggcagattcaggggcagatgccctatcccccaggagacctggcccttctctctcagacccaataagttggaagggacgtcagaagcggtcatctcatctgccccttattttatagttggaaaccctgaggcaagagagggaaagaggcctgtccaaggtccgggttagtgacagagctgagctgagaacagggacgttgtgccccactgtcccctgtggtttgtgaatgacctccaggtcagggggtcacaacttgttcttagtaaacttgccagctgttggggtcacatattcccattctggggcctcacaaacccccgaatccagccgggaccccatgccaggagctggtctagggacagcatgcttgtgacccacagactgttaaagccagaagggacctcagagagtcccttatgctggaggcgccctgtcagccgtggctaggggccccttgctctatgctgtgccttgctgcccacaggctcccagacaccagtgcccactctgcccagccccggactgggtgtggctcgcagatgaacaagatgcagggcctgccttgaggggtgtctcctagaaggaaagccagactctccggcccagccagagagtccagacatggcagggacccgtttctcagatgaggagcctgaggctcagagaagggaggcgatgtgttcagggccacccagcagaagcctgtggggctgggcaaccttctcccactttatgggaggagctgcagccttggctgggagctgggcggggagtagccaggaccaccccttgcccgtgccgtgacatggaaccttcatcactaagggggctggagtgggaagagggagataactgtgtggtctccagagcaaaagagaatgagaggtgggcagggggagtcttggcaaaagaccaagttccacttccctgctggggaagtcaaggctcagaaagaggaaataattgccccaggtaacacagggcagaggagggacaaaaagctgggcatggccccagccagagcctcatctgcctactccgtgaagcctcccaggtactctgctatcctgggaaacgcacagggaggccacacagagacactgctcacaagagtcagaccaaggtgccagcacagcctggaaagagctcagaaagggggttggtgcacgtggctgggcatcttaggaggcttcctgagggtgggtaaaggtgggaaggccctggcgctgcatcagatgagcagggcctggcagggacaagcctcttctcctttgggaagccctgcagcctcctagcaagaggctgattccccactctgcccccatctgaatgtccttttcatgttgcacgcagggaacctcaggaaggaggattgcctgatgcctgcctggctccatccttgagctctgggcaccacctagggtgagggagagcctgcagctctggggctaagtctgccctggggggaaagggctccacgctcacacgcacgcgctcgcacacacacactcacacctggacgcacacggaggcttgcggacccatactcacaggcacatgtggcctggggactgggggagcaggaaagacccctccaacatttggcccttggaaggcaccattgccaatgagcctctttgctggttcccccgaccccacctgggggtcccatgggagcccagcccagccaggtgtggggatgggccaccggccattcctgttttccttgtacagacagattctcactacccacccgccatccccagacacattttatttaataacttgtcattgttaaattatttattagcgtttaccacaccaccacccccaccctgccctccactctcaccttccacctcttcccacaacagcagaaaatggaaacaacaacaaaaaaagatgagacatcagtatatttgtaaataaaccgacctgtacactc

SEQ ID NO: 10 - DNA, 6291 bp, Homo sapiens
agccccagctctaaacccggcggctcagcgggcgcaccatggcactggagtagcgcggggagcgcgcccggagccccgcggcccgctgcgccccgcccgggaccccgctgcgccgcgcgccccccccgcggcccgcggggccgcccctgcacccccaccccctcccccgcctgccgccgccgccaccgccaccgccgccgccgcctcctccccgcggctccgtctgcagcagccgccgccgccgggttccgggactgacaagcaggtgacagaggagccggcgcgcgtggctgcaagtgtccgggagagcgcggcgcgggctgcagccgccccggcccgcccgcacgacgccggggcccggggccagcgcgtcgccgctccacgatcgccgggggccggcgcaacccctgccctgcgggggccgcgcctccccggttccagggccgcggcggcggagagcgggtggacgggccggcgggcgagcagcccggccggcggggtccgcagcgcgccccgcgtcccatggatatagcaacaggtcccgagtcgctggagaggtgcttccctcgcgggcagacggactgcgccaagatgttggacggcatcaagatggaggagcacgccctgcgccccgggcccgccactctgggggtgctgctgggctccgactgcccgcatcccgccgtctgcgagggctgccagcggcccatctccgaccgcttcctgatgcgagtcaacgagtcgtcctggcacgaggagtgtttgcagtgcgcggcgtgtcagcaagccctcaccaccagctgctacttccgggatcggaaactgtactgcaaacaagactaccaacagctcttcgcggccaagtgcagcggctgcatggagaagatcgcccccaccgagttcgtgatgcgggcgctggagtgcgtgtaccacctgggctgcttctgctgctgcgtgtgtgaacggcagctacgcaagggcgacgaattcgtgctcaaggagggccagctgctgtgcaagggtgactacgagaaggagaaggacctgctcagctccgtgagccccgacgagtccgactccgtgaagagcgaggatgaagatggggacatgaagccggccaaggggcagggcagtcagagcaagggcagcggggatgacgggaaggacccgcggaggcccaagcgaccccggaccatcctcaccacgcagcagcgaagagccttcaaggcctccttcgaggtctcgtcgaagccttgccgaaaggtccgagagacactggcagctgagacgggcctcagtgtgcgcgtggtccaggtctggtttcagaaccaaagagcaaagatgaagaagctggcgcggcggcaccagcagcagcaggagcagcagaactcccagcggctgggccaggaggtcctgtccagccgcatggagggcatgatggcttcctacacgccgctggccccaccacagcagcagatcgtggccatggaacagagcccctacggcagcagcgaccccttccagcagggcctcacgccgccccaaatgccagggaacgactccatcttccatgacatcgacagcgatacctccttaaccagcctcagcgactgcttcctcggctcctcagacgtgggctccctgcaggcccgcgtggggaaccccatcgaccggctctactccatgcagagttcctacttcgcctcctgagagccagccaggcgcacggacgcttgggcaggggcctgggggggactgccagcctctgcggccagcctggccacccccgccctgctctccgcacagactacagacagccatacggtgccctcccctcggccagctgggcctgaccactgtgcccgttgggtacagccagaccggtagatgggcacagcctgggcaggggctgtgtcctgcccacagagaccttgtcatccccagggacccagagctctcggacggccactcgcctcccagccccacctcggcctccatcgcctcctccccatctcttttttgggaagcttaaattctctctatttttttaaatgtcctctctgtgtccatggccctccatgcaagccccaggacaatggtgtcatgaggcggtgacctgagaagcgtgtgtacctgtgccccagcaagggcaggggtggcctctgggggcaggcccactgcctggaaccgcacacccctcagcctgagtctggagcagcagtggagaggggcctgaggggaggcactgtcaggaggcgggctcggagcctgagcctgggcaggcgcaaagggacagagaggcacgtgcagacacatgcacacttgcagacaaacccacgcaaacacacacacagctgtatggggacaccagaagggacagggatgctcagcgggtctgtcctgccttgtcagaaagagaaaaggaggccaggcaggggaccccccagttcttaagagcgattggaaagggaggaaggggagaggaagaggcgaacttgaagcatcggacccagttgtatcccagcctgggcccaaatgggggcagcctgggcagggagggcagccccaggccccaccaactctagaggcagatggagcccccagaaccaggtagcatcagaccagacaacagagcctccaggggtcagggacttcagaagcacctgctgggcaccccatctgcaatgtggtcctctccccagccacctctgcctcccctcacatacctccagtgacaaggagctcactaggtcagcgagcccacagcagctgtgctgtcctgcatcccagagccaggcttccccagctctccctcttaacactgtcccccagcaggcctccggctgtccctctaaaggtgtggggcaggtatcacttcaccttcccactgatgtcagccggccagaagtgagcaggcacatcacctctcctgctgtggcacccttcctctgttaatttggcccaaaagacaatgatttggccacatgaccttagagattcaccctgccctgctgtagctaaatccctgggccccacacgcaagtgacagctaagccacatctgttttctgtgtatatgcaggatgggggcacctactgttttgttttgttttgttttgttttgttttgttttgttttgttttgttttgtttgagacggagtttcgctcttgttgcccaggctggagtgcaatggcgcgatctcggctcaccacaacctccgcctcccaggttcaagtgattctgatgcctcagcctccctagtagctgagattacaggcatgcgccaccacacccagctaattttgtatttttagtagcaacggggtttctccatgttggtcaggctggtctccaacccccgacctcaggtgatccgcctgcctcggcctcccaaagtgctgggattacaggcgtgagccaccgcacccagtctgcacttactgtttagactgaatgagggaccgtgacctctttccttttccattccttcttactcgattcattccagcctgtggaatttctctgcaccctgattcagtgaccactgctctcctctctcccagcacatctgcccagtgaggagttggccctgggtctcacctgaggtgtgtggaccgggctggcctctccctgtttgacattggcccattaatgcatcctctttgggggacacattccaattgcatttcctgcccccttctcccagggcaattgcagaagattgtgtcaggcgccctgctggaagtcaggtgcactagatccatccccagccccagtctgctcaactctatccctgtcagagcaaggaggctgggctgctggggcctgactggtgagcccaccctgtcccctggtgatcactgtgtccccttgttcaggtgctcacaaccctacctttaactctgaggtcaagccctaggccaccaccctaaagtctgcctggtccaacctttgagcaagtaaggataatgaatgtcccttttccacctttggggccctctgcctggatctctggaatcctctaagttcaacctgttctgtggttttgctcccgtttgctgggaaattcagtccccccagaatgtcctgggccaacctccttgcctgacatgtggcctcgtgtcacccattgggccccagcagccagctagcccttctgcagctcttcttacaaacagagcctctccaaggacctcagttgatgttctggtccttctgccgcctcagcccaccagggtccgtgccaccatgggtctcttgagcagcagctgcactggcttctggagagacacccctctttctccttttgcacatgcaccatctgaatcgtgccagggacatcctgggcagattcaggggcagatgccctatcccccaggagacctggcccttctctctcagacccaataagttggaagggacgtcagaagcggtcatctcatctgccccttattttatagttggaaaccctgaggcaagagagggaaagaggcctgtccaaggtccgggttagtgacagagctgagctgagaacagggacgttgtgccccactgtcccctgtggtttgtgaatgacctccaggtcagggggtcacaacttgttcttagtaaacttgccagctgttggggtcacatattcccattctggggcctcacaaacccccgaatccagccgggaccccatgccaggagctggtctagggacagcatgcttgtgacccacagactgttaaagccagaagggacctcagagagtcccttatgctggaggcgccctgtcagccgtggctaggggccccttgctctatgctgtgccttgctgcccacaggctcccagacaccagtgcccactctgcccagccccggactgggtgtggctcgcagatgaacaagatgcagggcctgccttgaggggtgtctcctagaaggaaagccagactctccggcccagccagagagtccagacatggcagggacccgtttctcagatgaggagcctgaggctcagagaagggaggcgatgtgttcagggccacccagcagaagcctgtggggctgggcaaccttctcccactttatgggaggagctgcagccttggctgggagctgggcggggagtagccaggaccaccccttgcccgtgccgtgacatggaaccttcatcactaagggggctggagtgggaagagggagataactgtgtggtctccagagcaaaagagaatgagaggtgggcagggggagtcttggcaaaagaccaagttccacttccctgctggggaagtcaaggctcagaaagaggaaataattgccccaggtaacacagggcagaggagggacaaaaagctgggcatggccccagccagagcctcatctgcctactccgtgaagcctcccaggtactctgctatcctgggaaacgcacagggaggccacacagagacactgctcacaagagtcagaccaaggtgccagcacagcctggaaagagctcagaaagggggttggtgcacgtggctgggcatcttaggaggcttcctgagggtgggtaaaggtgggaaggccctggcgctgcatcagatgagcagggcctggcagggacaagcctcttctcctttgggaagccctgcagcctcctagcaagaggctgattccccactctgcccccatctgaatgtccttttcatgttgcacgcagggaacctcaggaaggaggattgcctgatgcctgcctggctccatccttgagctctgggcaccacctagggtgagggagagcctgcagctctggggctaagtctgccctggggggaaagggctccacgctcacacgcacgcgctcgcacacacacactcacacctggacgcacacggaggcttgcggacccatactcacaggcacatgtggcctggggactgggggagcaggaaagacccctccaacatttggcccttggaaggcaccattgccaatgagcctctttgctggttcccccgaccccacctgggggtcccatgggagcccagcccagccaggtgtggggatgggccaccggccattcctgttttccttgtacagacagattctcactacccacccgccatccccagacacattttatttaataacttgtcattgttaaattatttattagcgtttaccacaccaccacccccaccctgccctccactctcaccttccacctcttcccacaacagcagaaaatggaaacaacaacaaaaaaagatgagacatcagtatatttgtaaataaaccgacctgtacactc

SEQ ID NO: 11 - DNA, 6312 bp, Homo sapiens
agccccagctctaaacccggcggctcagcgggcgcaccatggcactggagtagcgcggggagcgcgcccggagccccgcggcccgctgcgccccgcccgggaccccgctgcgccgcgcgccccccccgcggcccgcggggccgcccctgcacccccaccccctcccccgcctgccgccgccgccaccgccaccgccgccgccgcctcctccccgcggctccgtctgcagcagccgccgccgccgggttccgggactgacaagcaggtgacagaggagccggcgcgcgtggctgcaagtgtccgggagagcgcggcgcgggctgcagccgccccggcccgcccgcacgacgccggggcccggggccagcgcgtcgccgctccacgatcgccgggggccggcgcaacccctgccctgcgggggccgcgcctccccggttccagggccgcggcggcggagagcgggtggacgggccggcgggcgagcagcccggccggcggggtccgcagcgcgccccgcgtcccatggatatagcaacaggtcccgagtcgctggagaggtgcttccctcgcgggcagacggactgcgccaagatgttggacggcatcaagatggaggagcacgccctgcgccccgggcccgccactctgggggtgctgctgggctccgactgcccgcatcccgccgtctgcgagggctgccagcggcccatctccgaccgcttcctgatgcgagtcaacgagtcgtcctggcacgaggagtgtttgcagtgcgcggcgtgtcagcaagccctcaccaccagctgctacttccgggatcggaaactgtactgcaaacaagactaccaacagctcttcgcggccaagtgcagcggctgcatggagaagatcgcccccaccgagttcgtgatgcgggcgctggagtgcgtgtaccacctgggctgcttctgctgctgcgtgtgtgaacggcagctacgcaagggcgacgaattcgtgctcaaggagggccagctgctgtgcaagggtgactacgagaaggagaaggacctgctcagctccgtgagccccgacgagtccgactccgtgaagagcgaggatgaagatggggacatgaagccggccaaggggcagggcagtcagagcaagggcagcggggatgacgggaaggacccgcggaggcccaagcgaccccggaccatcctcaccacgcagcagcgaagagccttcaaggcctccttcgaggtctcgtcgaagccttgccgaaaggtccgagagacactggcagctgagacgggcctcagtgtgcgcgtggtccaggtctggtttcagaaccaaagagcaaagatgaagaagctggcgcggcggcaccagcagcagcaggagcagcagaactcccagcggctgggccaggaggtcctgtccagccgcatggagggcatgatggcttcctacacgccgctggccccaccacagcagcagatcgtggccatggaacagagcccctacggcagcagcgaccccttccagcagggcctcacgccgccccaaatgccaggtgaccacatgaacccctatgggaacgactccatcttccatgacatcgacagcgatacctccttaaccagcctcagcgactgcttcctcggctcctcagacgtgggctccctgcaggcccgcgtggggaaccccatcgaccggctctactccatgcagagttcctacttcgcctcctgagagccagccaggcgcacggacgcttgggcaggggcctgggggggactgccagcctctgcggccagcctggccacccccgccctgctctccgcacagactacagacagccatacggtgccctcccctcggccagctgggcctgaccactgtgcccgttgggtacagccagaccggtagatgggcacagcctgggcaggggctgtgtcctgcccacagagaccttgtcatccccagggacccagagctctcggacggccactcgcctcccagccccacctcggcctccatcgcctcctccccatctcttttttgggaagcttaaattctctctatttttttaaatgtcctctctgtgtccatggccctccatgcaagccccaggacaatggtgtcatgaggcggtgacctgagaagcgtgtgtacctgtgccccagcaagggcaggggtggcctctgggggcaggcccactgcctggaaccgcacacccctcagcctgagtctggagcagcagtggagaggggcctgaggggaggcactgtcaggaggcgggctcggagcctgagcctgggcaggcgcaaagggacagagaggcacgtgcagacacatgcacacttgcagacaaacccacgcaaacacacacacagctgtatggggacaccagaagggacagggatgctcagcgggtctgtcctgccttgtcagaaagagaaaaggaggccaggcaggggaccccccagttcttaagagcgattggaaagggaggaaggggagaggaagaggcgaacttgaagcatcggacccagttgtatcccagcctgggcccaaatgggggcagcctgggcagggagggcagccccaggccccaccaactctagaggcagatggagcccccagaaccaggtagcatcagaccagacaacagagcctccaggggtcagggacttcagaagcacctgctgggcaccccatctgcaatgtggtcctctccccagccacctctgcctcccctcacatacctccagtgacaaggagctcactaggtcagcgagcccacagcagctgtgctgtcctgcatcccagagccaggcttccccagctctccctcttaacactgtcccccagcaggcctccggctgtccctctaaaggtgtggggcaggtatcacttcaccttcccactgatgtcagccggccagaagtgagcaggcacatcacctctcctgctgtggcacccttcctctgttaatttggcccaaaagacaatgatttggccacatgaccttagagattcaccctgccctgctgtagctaaatccctgggccccacacgcaagtgacagctaagccacatctgttttctgtgtatatgcaggatgggggcacctactgttttgttttgttttgttttgttttgttttgttttgttttgttttgttttgtttgagacggagtttcgctcttgttgcccaggctggagtgcaatggcgcgatctcggctcaccacaacctccgcctcccaggttcaagtgattctgatgcctcagcctccctagtagctgagattacaggcatgcgccaccacacccagctaattttgtatttttagtagcaacggggtttctccatgttggtcaggctggtctccaacccccgacctcaggtgatccgcctgcctcggcctcccaaagtgctgggattacaggcgtgagccaccgcacccagtctgcacttactgtttagactgaatgagggaccgtgacctctttccttttccattccttcttactcgattcattccagcctgtggaatttctctgcaccctgattcagtgaccactgctctcctctctcccagcacatctgcccagtgaggagttggccctgggtctcacctgaggtgtgtggaccgggctggcctctccctgtttgacattggcccattaatgcatcctctttgggggacacattccaattgcatttcctgcccccttctcccagggcaattgcagaagattgtgtcaggcgccctgctggaagtcaggtgcactagatccatccccagccccagtctgctcaactctatccctgtcagagcaaggaggctgggctgctggggcctgactggtgagcccaccctgtcccctggtgatcactgtgtccccttgttcaggtgctcacaaccctacctttaactctgaggtcaagccctaggccaccaccctaaagtctgcctggtccaacctttgagcaagtaaggataatgaatgtcccttttccacctttggggccctctgcctggatctctggaatcctctaagttcaacctgttctgtggttttgctcccgtttgctgggaaattcagtccccccagaatgtcctgggccaacctccttgcctgacatgtggcctcgtgtcacccattgggccccagcagccagctagcccttctgcagctcttcttacaaacagagcctctccaaggacctcagttgatgttctggtccttctgccgcctcagcccaccagggtccgtgccaccatgggtctcttgagcagcagctgcactggcttctggagagacacccctctttctccttttgcacatgcaccatctgaatcgtgccagggacatcctgggcagattcaggggcagatgccctatcccccaggagacctggcccttctctctcagacccaataagttggaagggacgtcagaagcggtcatctcatctgccccttattttatagttggaaaccctgaggcaagagagggaaagaggcctgtccaaggtccgggttagtgacagagctgagctgagaacagggacgttgtgccccactgtcccctgtggtttgtgaatgacctccaggtcagggggtcacaacttgttcttagtaaacttgccagctgttggggtcacatattcccattctggggcctcacaaacccccgaatccagccgggaccccatgccaggagctggtctagggacagcatgcttgtgacccacagactgttaaagccagaagggacctcagagagtcccttatgctggaggcgccctgtcagccgtggctaggggccccttgctctatgctgtgccttgctgcccacaggctcccagacaccagtgcccactctgcccagccccggactgggtgtggctcgcagatgaacaagatgcagggcctgccttgaggggtgtctcctagaaggaaagccagactctccggcccagccagagagtccagacatggcagggacccgtttctcagatgaggagcctgaggctcagagaagggaggcgatgtgttcagggccacccagcagaagcctgtggggctgggcaaccttctcccactttatgggaggagctgcagccttggctgggagctgggcggggagtagccaggaccaccccttgcccgtgccgtgacatggaaccttcatcactaagggggctggagtgggaagagggagataactgtgtggtctccagagcaaaagagaatgagaggtgggcagggggagtcttggcaaaagaccaagttccacttccctgctggggaagtcaaggctcagaaagaggaaataattgccccaggtaacacagggcagaggagggacaaaaagctgggcatggccccagccagagcctcatctgcctactccgtgaagcctcccaggtactctgctatcctgggaaacgcacagggaggccacacagagacactgctcacaagagtcagaccaaggtgccagcacagcctggaaagagctcagaaagggggttggtgcacgtggctgggcatcttaggaggcttcctgagggtgggtaaaggtgggaaggccctggcgctgcatcagatgagcagggcctggcagggacaagcctcttctcctttgggaagccctgcagcctcctagcaagaggctgattccccactctgcccccatctgaatgtccttttcatgttgcacgcagggaacctcaggaaggaggattgcctgatgcctgcctggctccatccttgagctctgggcaccacctagggtgagggagagcctgcagctctggggctaagtctgccctggggggaaagggctccacgctcacacgcacgcgctcgcacacacacactcacacctggacgcacacggaggcttgcggacccatactcacaggcacatgtggcctggggactgggggagcaggaaagacccctccaacatttggcccttggaaggcaccattgccaatgagcctctttgctggttcccccgaccccacctgggggtcccatgggagcccagcccagccaggtgtggggatgggccaccggccattcctgttttccttgtacagacagattctcactacccacccgccatccccagacacattttatttaataacttgtcattgttaaattatttattagcgtttaccacaccaccacccccaccctgccctccactctcaccttccacctcttcccacaacagcagaaaatggaaacaacaacaaaaaaagatgagacatcagtatatttgtaaataaaccgacctgtacactc

SEQ ID NO: 12 - DNA, 6234 bp, Homo sapiens
cccttgcttttggtgatggttgtgagtgcagaagttgattgacagatgcatgccagaaacccccattctccttttcaaagacaacatatgatggattgctatctctcagcgcagcaggacacggggaccatgcaagctgtaattggtcaggcatgaactctcttgggttgtgttaccctgtttgctgtttactgtcaagatgctgaaagaatgttcttataatgatccaagaggaagtggcaaatgagtgctcttcttcaggatccaatgatagctggacaagtcagtaagcccttgctgtcagtgcggagtgaaatgaatgcggagttgagaggtgaggacaaggctgctacttcagacagcgagctgaatgagcccctgcttgcgcctgtggaatcaaatgacagcgaggacactcccagcaagctcttcggggctagaggaaacccagcattatcagacccaggcactcctgaccaacaccaggccagtcagacccaccccccatttccagttgggccacagccacttctgacggcacagcagttagcttctgctgtggccggcgtgatgccgggaggccccccagccctcaaccagccaatcctcattcccttcaacatggcgggacagctaggaggccagcaaggactggttctcacactgccaacagcgaatctcaccaacatccaagggctggtggcagcagctgcagccggaggcattatgactctgccactgcaaaatctacaagctacctcatccctgaactcccagctccagcagctccagctccagctccagcagcagcagcagcagcagcagcagcagcctcccccgtcaaccaaccagcacccgcaaccagccccacaggcgccctcgcagtcccagcagcagccgctgcagcccaccccaccccagcagccaccacccgcctctcagcagccgccagctcctacatctcagctgcaacaggcgcctcagccccagcagcaccaaccccactcccactcccagaaccagaaccaaccatctccaacccagcagagctccagccccccgcagaaacctagtcagtctccaggacatggcctgccttcaccgctcacgccacccaatcctctacagctggttaataatccactagcaagtcaggctgcagcggctgcagcagccatgagctccatagcaagctcacaggcctttggcaatgccctctccagtcttcagggggtcacaggtcaactagttactaatgcacaaggacagattatcgggaccattccactgatgcctaatccagggccatcgagccaagcagcaagcggcactcagggcttgcaagtgcagccaatcaccccccagctcctcacaaacgcccagggccagatcatcgccacagtcattgggaaccagatcctgcccgtgatcaacacccagggcatcacgctgtcacccatcaagcccggccagcagctccaccaaccctcccagacgtcagtgggtcaagcagcctcccaaggcaaccttctgcacctggctcacagccaagcatccatgtctcaaagtcccgtccggcaggcttcctcttcttcctcctcatcctcctcttcttcagctttgagcgtgggccagttagtcagcaatcctcaaacggcagcgggtgaggtggatggggttaatctggaggagatccgagaatttgccaaagcttttaaaatccggcgcctgtcccttggcctgacccagactcaggtgggacaggctctcagtgctacagagggccccgcgtacagccagtcggccatctgcagacacaccatcctgagaagccactttttcctaccacaggaagcccaagagaacactatagctagcagtctgacagccaaactgaaccctggccttttgtatcctgccaggtttgaaaagctggacatcacccctaaaagtgcccagaagatcaagccggtgcttgagcggtggatggctgaggctgaggcccgccatcgagcaggtatgcagaacctgaccgagtttatcgggagtgaaccatccaaaaagcgcaagcggcgcacctccttcacaccccaggcccttgagatcctcaatgcccactttgagaagaacacacacccttctgggcaggaaatgaccgaaattgctgagaagctgaactatgaccgagaagtagttagagtttggttctgcaataagaggcaagccctgaagaacacaattaaacgcttaaaacagcacgagccggccacggcagtccctttggagcccttaacagactctctggaagaaaactcctaaagagatgcccacccataatcagaagcaaaattcacagaaactaaactccacccttgggactccacaacaacaacaacaacaaaatttaatttaatttaaaaatagccccagtcgtcatcacccttgtaagtaaatgactaagaaaactaccaagtggacagaatggtttctacatgtccgttggttttccaaaaaggaaagaagaaaatttttagaaaatttttaaacaaggaatacaccacactgaaggtgtgtgtggtaggatagttcccttcccccacctgtctcccccaaagccagttttttaatggacttaaagcaaaccaaataaccacgtacttttttctgtatattatgaaaatgtgaacacattttaaggaaaaagaaaaaaaaaaactaaaccaaaaaccaacaacgaaggaacaaaaactttgatctgttcaaagcgaatacaagcctgccacctggaggaaggactgcaccccttcaggtactaagtgctgattcactatgaaacctattaaccaaagtcagaaacatggcattgcaacgcgatcgttcgtctacgcttctccgcacgtaaagttgtgttacgaatttttacatttgtactaacagaacaataggaagcctgatttctcccatctttcccatctactgtctccacccatggggtgggtaccattgttgaagccattctgtgaggctcactattgggtttttttgtgggggtggtagggagggtggtcttttttctttgtctttctttttgacgggagggcatcctggatcgtgtgccaaagcatttgttgcttttttctcactatgacttgtgggtttgagaaaagaaaatggagctcgcatttctctcttttcctccatttctccatctccctcgcgcgtggctcctggggtctgctggaaggccacagaagtggggagaagcagtgtcttttccactcagatcctagtgaaatgcaggagagactccaaaataactagggctttgctcgatgaactgtcaacactggcataagctgtaattgtgctcactgtccacaccagagcttgggatttttctcagtctgttggccacgtacatggagagctgaccaaaactaattttgtaatataaacataagctgcacatttggttcaatacttacatctatgttatgcttctgtgcaaagcaatttctctcagaagtctgatagccaaagaaatgtctcaagatttcagtcaaatacacacatgacatgcacacacccataaacacacacacaaagaaacaggctaaaaagaaagtgatagcaactggatcattaaaggccatcgtgtatcctgttaatctcatcttttctgctacttctttcattccaatagcgatggcagacttttttcagggggaataattactcttcgggatatataaatggagcagaaaggtggcgggcaaatttaaacaactggaattgggggccaggttcttcaggggaaaggaagtttgaagaagctttcaccaaaagaaaaaaatatagaaggggcttatctaacaatcagaatagcctgcaatatgagaactagaggattatttcctttaaaaaaaataacttaaaagatctgtgggccacaataacctaataagcaaggacatgttgggatgtgaggacggctgtgcaggtgagcacttggcagctgccactggtgttttcacccaggtacaggcagacggtgttccattaaaggagcaggcaaaagagagctgtcaatttgcttgctgttgaaatgtacatatttatgcataatttataatcatgctaatgtattatctagaagtaagttgtgaaagaaaaaagagaaacccaatctcaagttgcccaactgattagaaatgccatctccttcccctaatacactccctctccctggggagtttgagtttcttctgttggctcctttgctgtttgtgtaaatgctacagtataattgtcccctccaatgattcatgcagcaatcaagagactaccagcaaggaaactctaaaaggaatcctggaagtggaacaagtcactcgtaaaggtgtttccattttaccagtcaatgctaactggaccacagctaacttgatcttcaatgccaacatcacagagcccctttcgccacctcaaaaactgcacaaacatggacaacccagaaacccaaaactttattgattaaaacagattttggattctcctaggacctgctccaaattccatcaagaaaagctccctgcgaagagaagttaacaagataacatatgatggatgctaaatatttaaatatatgccggcagcggttacataaggcctgctcagttctgagatctataattgggagggtctaactaggacagggaaaatataaaataaaagtaatcttccagagtggaacaaaaaagaaatatattcatccgacagtcgtaacaccattcatgtgcagtgatttttttatagttttataattttgtattgttttataaattatttataaggtgttgtaatgcttcttatattaattttttacagataaattttttgctacaaggcataaaaaggtgcctgaaccgattcttaggaatataaattatactgtgtaactcataagtctttgggaccacacctaatgcttaattttatgatgacatttctcatgtctacttgtaaacaacttcatatgccaatggcgtttaagtgtcttttatgtttccatgaactgaaggttaaggttgccacccacaaaaaataaaagccactttgggcatatgtgattgtatttcaagcttcagtatttttctcacataatttttaattattgttatctgcattttcattacttcatgaaaaaatgacagtggatattacattttacacttgtttatagattttctttctttttcaaccaagaaaatattttgaacaattgaaacttttaattgcatttgcaaggttttggcttctttatgttgtcatcacacagatgcacacacacatacacatacaacacaaaagagagaacaaaaaagcaaaaggagctaggaaaaaaacaaaacaaaacaagtagaggtgtatcaaagaactcaagctataaccaaaaagaaatcgtaaaatgcctttgctcgtttctctacgctggaccaaagctcaatatttgtaggtatatgcacattgtatagatatggctaaatgttgctgacaatctcgcaatactaaactgttcctattttaagaaaaaaaaaagaaatacaaactgttcatcaatgttttacctcagcactctacttgtacccagttaatgaccaagcttaaaaaaaaattgagataaaggaaattgattttcatttcaatgtttgactgtaaaatctgtttggataacattttgtaatgagctttttgtcatgtgatttgcttgtcttcaacttgaaattatgtgaggcacatttgtttatttgttgttaagaaagtgatttttttttttttttgtcctatgtgctgtgatctagactggtcaccggggtcacttatgaggcaccacaaagagatctgcttctccgtgcccggagcaggcagcaggagggagggcaggaaacaggactgggttgctttggaaaaatcatcatgacaagaagttgacatgatagacttgtgaccaagaagccaaactgaatatttaaaagctccttacttgctctgacattgaaaccaaagctgattttatctgcacaggttgcttaatatttaaaaaaaaaaaaaactgtacttaatctagagcaatatctgtatggtcagtaaagctgcactttgtgtatttcttaacagcttcagatctgtcacttttaatttgtaccataaaaaataaataattgtttgacatga

SEQ ID NO: 13 - DNA, 6126 bp, Homo sapiens
cccttgcttttggtgatggttgtgagtgcagaagttgattgacagatgcatgccagaaacccccattctccttttcaaagacaacatatgatggattgctatctctcagcgcagcaggacacggggaccatgcaagctgtaattggtcaggcatgaactctcttgggttgtgttaccctgtttgctgtttactgtcaagatgctgaaagaatgttcttataatgatccaagaggaagtggcaaatgagtgctcttcttcaggatccaatgatagctggacaagtcagtaagcccttgctgtcagtgcggagtgaaatgaatgcggagttgagaggtgaggacaaggctgctacttcagacagcgagctgaatgagcccctgcttgcgcctgtggaatcaaatgacagcgaggacactcccagcaagctcttcggggctagaggaaacccagcattatcagacccaggcactcctgaccaacaccaggccagtcagacccaccccccatttccagttgggccacagccacttctgacggcacagcagttagcttctgctgtggccggcgtgatgccgggaggccccccagccctcaaccagccaatcctcattcccttcaacatggcgggacagctaggaggccagcaaggactggttctcacactgccaacagcgaatctcaccaacatccaagggctggtggcagcagctgcagccggaggcattatgactctgccactgcaaaatctacaagctacctcatccctgaactcccagctccagcagctccagctccagctccagcagcagcagcagcagcagcagcagcagcctcccccgtcaaccaaccagcacccgcaaccagccccacaggcgccctcgcagtcccagcagcagccgctgcagcccaccccaccccagcagccaccacccgcctctcagcagccgccagctcctacatctcagctgcaacaggcgcctcagccccagcagcaccaaccccactcccactcccagaaccagaaccaaccatctccaacccagcagagctccagccccccgcagaaacctagtcagtctccaggacatggcctgccttcaccgctcacgccacccaatcctctacagctggttaataatccactagcaagtcaggctgcagcggctgcagcagccatgagctccatagcaagctcacaggcctttggcaatgccctctccagtcttcagggggtcacaggtcaactagttactaatgcacaaggacagattatcgggaccattccactgatgcctaatccagggccatcgagccaagcagcaagcggcactcagggcttgcaagtgcagccaatcaccccccagctcctcacaaacgcccagggccagatcatcgccacagtcattgggaaccagatcctgcccgtgatcaacacccagggcatcacgctgtcacccatcaagcccggccagcagctccaccaaccctcccagacgtcagtgggtcaagcagcctcccaaggcaaccttctgcacctggctcacagccaagcatccatgtctcaaagtcccgtccggcaggcttcctcttcttcctcctcatcctcctcttcttcagctttgagcgtgggccagttagtcagcaatcctcaaacggcagcgggtgaggtggatggggttaatctggaggagatccgagaatttgccaaagcttttaaaatccggcgcctgtcccttggcctgacccagactcaggtgggacaggctctcagtgctacagagggccccgcgtacagccagtcggccatctgcaggtttgaaaagctggacatcacccctaaaagtgcccagaagatcaagccggtgcttgagcggtggatggctgaggctgaggcccgccatcgagcaggtatgcagaacctgaccgagtttatcgggagtgaaccatccaaaaagcgcaagcggcgcacctccttcacaccccaggcccttgagatcctcaatgcccactttgagaagaacacacacccttctgggcaggaaatgaccgaaattgctgagaagctgaactatgaccgagaagtagttagagtttggttctgcaataagaggcaagccctgaagaacacaattaaacgcttaaaacagcacgagccggccacggcagtccctttggagcccttaacagactctctggaagaaaactcctaaagagatgcccacccataatcagaagcaaaattcacagaaactaaactccacccttgggactccacaacaacaacaacaacaaaatttaatttaatttaaaaatagccccagtcgtcatcacccttgtaagtaaatgactaagaaaactaccaagtggacagaatggtttctacatgtccgttggttttccaaaaaggaaagaagaaaatttttagaaaatttttaaacaaggaatacaccacactgaaggtgtgtgtggtaggatagttcccttcccccacctgtctcccccaaagccagttttttaatggacttaaagcaaaccaaataaccacgtacttttttctgtatattatgaaaatgtgaacacattttaaggaaaaagaaaaaaaaaaactaaaccaaaaaccaacaacgaaggaacaaaaactttgatctgttcaaagcgaatacaagcctgccacctggaggaaggactgcaccccttcaggtactaagtgctgattcactatgaaacctattaaccaaagtcagaaacatggcattgcaacgcgatcgttcgtctacgcttctccgcacgtaaagttgtgttacgaatttttacatttgtactaacagaacaataggaagcctgatttctcccatctttcccatctactgtctccacccatggggtgggtaccattgttgaagccattctgtgaggctcactattgggtttttttgtgggggtggtagggagggtggtcttttttctttgtctttctttttgacgggagggcatcctggatcgtgtgccaaagcatttgttgcttttttctcactatgacttgtgggtttgagaaaagaaaatggagctcgcatttctctcttttcctccatttctccatctccctcgcgcgtggctcctggggtctgctggaaggccacagaagtggggagaagcagtgtcttttccactcagatcctagtgaaatgcaggagagactccaaaataactagggctttgctcgatgaactgtcaacactggcataagctgtaattgtgctcactgtccacaccagagcttgggatttttctcagtctgttggccacgtacatggagagctgaccaaaactaattttgtaatataaacataagctgcacatttggttcaatacttacatctatgttatgcttctgtgcaaagcaatttctctcagaagtctgatagccaaagaaatgtctcaagatttcagtcaaatacacacatgacatgcacacacccataaacacacacacaaagaaacaggctaaaaagaaagtgatagcaactggatcattaaaggccatcgtgtatcctgttaatctcatcttttctgctacttctttcattccaatagcgatggcagacttttttcagggggaataattactcttcgggatatataaatggagcagaaaggtggcgggcaaatttaaacaactggaattgggggccaggttcttcaggggaaaggaagtttgaagaagctttcaccaaaagaaaaaaatatagaaggggcttatctaacaatcagaatagcctgcaatatgagaactagaggattatttcctttaaaaaaaataacttaaaagatctgtgggccacaataacctaataagcaaggacatgttgggatgtgaggacggctgtgcaggtgagcacttggcagctgccactggtgttttcacccaggtacaggcagacggtgttccattaaaggagcaggcaaaagagagctgtcaatttgcttgctgttgaaatgtacatatttatgcataatttataatcatgctaatgtattatctagaagtaagttgtgaaagaaaaaagagaaacccaatctcaagttgcccaactgattagaaatgccatctccttcccctaatacactccctctccctggggagtttgagtttcttctgttggctcctttgctgtttgtgtaaatgctacagtataattgtcccctccaatgattcatgcagcaatcaagagactaccagcaaggaaactctaaaaggaatcctggaagtggaacaagtcactcgtaaaggtgtttccattttaccagtcaatgctaactggaccacagctaacttgatcttcaatgccaacatcacagagcccctttcgccacctcaaaaactgcacaaacatggacaacccagaaacccaaaactttattgattaaaacagattttggattctcctaggacctgctccaaattccatcaagaaaagctccctgcgaagagaagttaacaagataacatatgatggatgctaaatatttaaatatatgccggcagcggttacataaggcctgctcagttctgagatctataattgggagggtctaactaggacagggaaaatataaaataaaagtaatcttccagagtggaacaaaaaagaaatatattcatccgacagtcgtaacaccattcatgtgcagtgatttttttatagttttataattttgtattgttttataaattatttataaggtgttgtaatgcttcttatattaattttttacagataaattttttgctacaaggcataaaaaggtgcctgaaccgattcttaggaatataaattatactgtgtaactcataagtctttgggaccacacctaatgcttaattttatgatgacatttctcatgtctacttgtaaacaacttcatatgccaatggcgtttaagtgtcttttatgtttccatgaactgaaggttaaggttgccacccacaaaaaataaaagccactttgggcatatgtgattgtatttcaagcttcagtatttttctcacataatttttaattattgttatctgcattttcattacttcatgaaaaaatgacagtggatattacattttacacttgtttatagattttctttctttttcaaccaagaaaatattttgaacaattgaaacttttaattgcatttgcaaggttttggcttctttatgttgtcatcacacagatgcacacacacatacacatacaacacaaaagagagaacaaaaaagcaaaaggagctaggaaaaaaacaaaacaaaacaagtagaggtgtatcaaagaactcaagctataaccaaaaagaaatcgtaaaatgcctttgctcgtttctctacgctggaccaaagctcaatatttgtaggtatatgcacattgtatagatatggctaaatgttgctgacaatctcgcaatactaaactgttcctattttaagaaaaaaaaaagaaatacaaactgttcatcaatgttttacctcagcactctacttgtacccagttaatgaccaagcttaaaaaaaaattgagataaaggaaattgattttcatttcaatgtttgactgtaaaatctgtttggataacattttgtaatgagctttttgtcatgtgatttgcttgtcttcaacttgaaattatgtgaggcacatttgtttatttgttgttaagaaagtgatttttttttttttttgtcctatgtgctgtgatctagactggtcaccggggtcacttatgaggcaccacaaagagatctgcttctccgtgcccggagcaggcagcaggagggagggcaggaaacaggactgggttgctttggaaaaatcatcatgacaagaagttgacatgatagacttgtgaccaagaagccaaactgaatatttaaaagctccttacttgctctgacattgaaaccaaagctgattttatctgcacaggttgcttaatatttaaaaaaaaaaaaaactgtacttaatctagagcaatatctgtatggtcagtaaagctgcactttgtgtatttcttaacagcttcagatctgtcacttttaatttgtaccataaaaaataaataattgtttgacatga

SEQ ID NO: 14 - DNA, 1419 bp, Homo sapiens
catttctactttgcccgcccacagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaa

SEQ ID NO: 15 - DNA, 4881 bp, Homo sapiens
gaactgggccgggcggccgtgcgggagccatggcggcctcggaggcggcggcggcggcggggtccgcggctctggcggcgggtgcccgggccgtcccggcggccacgacaggagccgccgccgccgcctcgggcccgtgggtgcccccgggaccccgactgaggggcagccggccgcggcccgcgggggcgacgcagcagcccgctgtccccgcgccgccggcgggggagctgatccagccgtcggtgagcgagctgtcccgggccgtgcggaccaacatcctgtgcaccgtgcgcggctgcggcaagatcctgcccaacagccccgcgctcaacatgcacctagtcaagagccaccgcctgcaggatggcatagtcaatccaacaataagaaaagatttgaaaactggaccgaaattctactgctgtccaattgaaggctgccccagaggccctgagagaccgttttctcagttttctctcgtaaaacagcactttatgaaaatgcatgctgagaagaagcacaaatgtagtaagtgcagcaattcgtacggtacagaatgggacctgaaaagacatgcagaggactgtggcaagaccttccggtgcacatgcggctgtccctacgccagtagaacagcactgcagtctcacatctaccgaactgggcacgagatacctgcagaacacagggacccacctagtaagaaaaggaaaatggaaaactgtgcacaaaaccagaagttatccaacaagaccattgaatcattgaacaaccaaccaatccctagaccagacactcaagaactagaagcttcagaaataaagctagaaccatcttttgaagactcttgtggctctaacactgacaagcagactcttacaacaccaccgagatatcctcagaagttgcttttaccaaagcccaaagtggctttggttaaactacccgtgatgcagttttctgtcatgcctgtctttgtgcctacagccgactcctcagcccagcctgtggtgttaggtgttgatcagggctctgccacaggggctgtgcacttaatgcccttgtcagtaggaaccctgatcctcggcctagattcagaggcttgctctcttaaggagagcctacctcttttcaaaattgctaatcctattgctggtgagccaataagtactggtgttcaagtgaactttggtaaaagtccatctaatcctttacaagaactagggaacacgtgtcaaaagaatagcatttcttcaatcaacgtgcagacagatctgtcttatgcctcacaaaactttataccttctgcacagtgggccactgctgattcctctgtgtcgtcttgttctcaaactgatttgtcgtttgattctcaagtgtctcttcccattagtgttcacactcagacatttttgcccagctctaaggtaacttcatctatagctgctcagactgatgcatttatggacacctgtttccagtcaggtggggtctccagagaaactcaaaccagtgggatagaaagtccaacggatgaccatgtacagatggaccaagctggaatgtgcggagacatttttgagagtgttcattcatcatataatgttgctacaggtaacattataagcaacagtttagtagcagagacagtaactcatagtttgttacctcagaatgagcctaagactttaaatcaagatattgagaaatctgcaccaattataaatttcagtgcacagaatagtatgcttccttcacagaacatgacagataatcagacccaaaccatagatttattaagtgatttggaaaacatcttgtcaagtaatctgcctgctcagacattggatcatcgtagtcttttgtctgacacaaatcctggacctgacacccagctcccatctggcccagcccagaaccccggaatcgattttgatatcgaagagttcttttcggcctcaaatatccagactcaaactgaagagagtgaacttagcaccatgaccaccgagccagtcttggagtcactggacatagagactcaaacggacttcttactcgcagatacctctgctcagtcctatgggtgtaggggaaattctaacttcttaggccttgagatgtttgacacacagacacagacagacttaaactttttcttagacagtagccctcatctgcctctgggaagtattctgaaacactccagcttttccgtgagtactgattcatctgacacagagacccaaactgaaggagtctccactgctaaaaatatacctgctctagaaagcaaagttcagttgaacagtacagaaacacagaccatgagttctgggtttgaaaccctggggagcttgttcttcaccagcaacgaaactcagacagcaatggatgactttcttctggctgatctggcctggaacacgatggagtctcagttcagctctgtagaaacccagacttctgcggaaccacacacagtctccaacttctaaaactaacggtggagtccatgtgtgaaatggcatctaccatttcctctggattaaaactacggactggggacaacagtattaattcgattgaatgtggctgatgatgcagttgcttagcttctttgtgtttctttgccttttgtacttgtaaacagaaatttgcgtataaatgtgagtgtattataaagtttgagatgttgatctaaattgtttttgtgttgcctacatttgccttttcacagctagtcttttcatgttaaaaaaaaaaatgtatttcatatctataaaacctatatagccatttagctgaagcccagcttaccaggttcaagggtacaaacttctcaaatcttcaaaacattttagtcaaagtgtaatatacttaaactgcacctaaaatatctttggcactgcttgttagaaattcctgattcctgttactaatcactaaagaaaccggatgctgccaccgtaggatttaagcagtagtgcttccatgctcttaagactcctgctgcctggaccttcgtcagctttgacacctcttttctgatttaaagacaccaaggaaaactacaactgtctttagctttgaagcagttttcatgtaatcattgccacctcttcgctacatgaactactattgataccagcatacaagtgtacagcactttacacacaagaggtttattgatgtaaaattatcggctagggaagcagcagcgggccaggtgtggtggcttacccctgtaatcccagcactttgggaggccaaagcaggacgatcacttgagcccaggagttcaacaccagcttgggcaacgtaagaagaccgtgtctctggaatttttttttttttttaattagccaggcacagtggcatgcgcctgtgatcccagctacttggaaggctgaggtgagaggatcactcgaggagattggggctgccatgagccatggtcttggcactgtactccaacctgggtaacagggcaagaccctatctcaaaaaaaaaaaaagtcgccagcaacaagcacgtagtgtagtgttcctgctaaatgagcgtaggttatccaaaccttgggaacagggagttatggaaacatgcctatgacttcatcttggggtgtgtcctatgaagatcctttctggtctccacagtaggccagagttgggggctctggagctgtttccccaagtgcatccacaagctggatctgagttttgtcactctaaaattaaacaagaaaaaaagtgggaaaagggcatcccccattaggtttcaatactttgcacttctactaagcttgatagggcaggagtgcaatctacaattattttaaagtgaatttccttccattcaccattctttatcttttctttgaataagaaaaagtatctagcaaggatattacttgtgccttgaggctagcaattataggatagattcatctaaaatatggtattctgcattttggttttttttcttaagtgaataataccagtcttcaaagaaaacaaggtgaagacctattgcttcaataatcaagaatgctttgtgtgttttgaggtaggagcatgatcaagtatgctttggggattttctgtatttaggagatcctggattcttaattgttggctaagttccagtcaagtaggaatcagtgcagcctgtaagttctccacattgacacacacacacacacacacacacacacacgacatgctcctttctgtggcacatgcctgtattactgaaagctaaatcctcaaaacctagtaaggggactaatgattcattaaagtaaattgatggttttgctactaattcctatcccatacatttgacacaaaagaagtgttggtaatggataaataacatatcccgggcagatgagctcaacctagtaggtaagagtttggtttggtcacagttgcctatgagtgtgggtttcaaaagaaacataaagccttaacttagaatttcattatgttttagaatcatcactgccttaatattcaagcatctatttaagtcctaataaaggagaaatgcatgtttatggcttttttgtaaatataaatgcagtgatctatggcttaaaaaatttgtttctgtgacaatgtttgtaaatctagccaatagagtcatttacagaagaaaaatgagcatgtaataatacaagaactgtttccccctcaaaacctgaacctgaattatttgtaaaaactgaaatttaatgattaaagagaagccagaattgtacccttttttgtgaattcttgaacgtactcataaatatgacttattgtattgccttaagttttcactcattgtcttttgaaagccatatgataaaatgattttatttaataata

SEQ ID NO: 16 - DNA, 3152 bp, Homo sapiens
attcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaagagaaagatggtctcctgagttttttaaaatagctcacttggtgtgatatggctgactcccatgtccttctttcttggctgaagcaaaccagttaatctcagtgtaatttcattcagcttttcatgtgctttgtattcaatcagaata

SEQ ID NO: 17 - DNA, 1252 bp, Homo sapiens
aggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccggccgccgggacagcagactgccggtaacgcgcggccggggcgggagagactcagcaacgacccatacctcagacccgacggcccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgc

SEQ ID NO: 18 - DNA, 3164 bp, Homo sapiens
agtctcccgccgccgccgccgctgccggacgcgcagagcgaggggcggctggaccgacggctgccgggccgagcgcacagagtcgcggcgcagggggcgtccccggccgggacgcgggtcgcgtcgttgtcctccgcgagcgtccggattgcaggctgtctgtccccagaccccagagcacgtccggcaccaccatgactgggctgttgaagaggaaatttgaccagctggatgaggacaactcctcggtctcctcctcctcctcttcctctgggtgccagtctcgctcctgctccccaagctcttctgtctcccgtgcctgggactcagaggaggaaggcccctgggatcagatgcccctgcctgaccgtgacttctgcggccccagaagtttcacccccctgtctatcctgaagcgggctcgccgggagcgcccaggccgtgtagcctttgatgggatcaccgtcttctacttcccccgctgccagggcttcaccagtgtgcccagccgtggtggctgtactctgggtatggcccttcgccacagtgcttgccgtcgcttctctttggctgagtttgcgcaggagcaagcccgtgcacggcacgagaagctccgccagcgcttgaaagaggagaagttggagatgctgcagtggaagctttcggcagctggggtaccccaggcagaggcagggctgccacctgtggtggatgccattgatgacgcctctgtggaggaggacttggcagtcgctgtggcaggtggccggttggaagaagtgagcttcctacagccctacccagcccggcgacgtcgagctctgctgagggcttcaggtgtgcgaaggatcgatcgggaggagaagcgggagctgcaggcactgcgccaatcccgggaggattgtggctgtcactgcgataggatctgcgaccctgagacctgcagctgcagcctggcaggcatcaagtgccagatggaccacacagcattcccctgtggctgctgcagggagggctgtgagaaccccatgggccgtgtggaatttaatcaggcaagagttcagacccatttcatccacacactcacccgcctgcagttggaacaggaggctgagagctttagggagctggaggcccctgcccagggcagcccacccagccctggtgaggaggccctggtccctactttcccactggccaagccccccatgaacaatgagctgggagacaacagctgcagcagcgacatgactgattcttctacagcatcttcatcagcatcgggcactagtgaggctcctgactgccccacccacccaggcctgcctggccctggcttccagcctggcgttgatgatgacagcctggcacgcatcttgagtttcagtgactctgacttcggtggggaggaggaggaagaggaggaagggagcgtggggaacctggacaacctcagctgcttccatccagctgacatctttggtactagtgaccctggtggcctggccagctggacccacagctattctggctgtagcttcacatcaggcgtcctggatgagaatgccaacctggatgccagctgcttcctaaatggtggccttgaagggtcaagggaaggcagccttcctggcacctcagtgccacccagcatggacgctggccggagtagctcagtggatctcagcttgtcttcttgtgactcctttgagttactccaggctctgccagattatagtctggggcctcactacacatcacagaaggtgtctgacagcctggacaacatcgaggcacctcacttccccctgcctggcctgtctccacctggggatgccagcagttgcttcctggagtccctcatgggcttctccgagccagccgccgaagccctagatccctttattgacagccagtttgaggacactgtcccagcatctctaatggagcctgtgccggtgtgaggaccaggatgtcttttcccagccccaagagacctgttgctgctttcttgtaattatggggctccccagagtctgcgtaacagtctcccactggctggctcacccacaggtgccatgtgcacactcctggttttcaaacaattctctggatttatttatttgttttaacttttctgtgctgaagagaggactggggggagggggcttcccctttcagctgcccggccccccacacccacagcttgctcttctatctccacaacgtgagcctggaagaggagaaaatgtggctcctctggagcttggcagaccacttttcggtctttgcgtgatgttccttagcccaaagacggtgagacagggctgaaatcaggtggcttctgccaccctgagccctagacccatgggtggctaaatccactggactgtgaagactataatttatttccataatttatttggagattgaggaggctttggttgcacttctttggctggtgggtaatgccaggggtggggtgggcacaggccctcaagagccccttttgccttgtagtcctacaccttgccctgcctgggctttggtgcagactaggtgtggatttgagctctgtgatctatgtctgctgcctggctcctagatggctctgtgggcaggtgctggccaaggacatcatctaggcagggggagagcctgggctgaacagctgtgaccaaaactcccttctgccccaccctgccccctccacttcctgccctctgttccatcttcccccttcccaaaggccacagcctttattccaggcccagggatgtaggagggggaaggaggaaacaggaagcccagagagggcaaagggcctacctcggggcgcgaaccatgccccagactattatctcagggctttctgggcactgcacttcagcgtggcccacctgcccatgccctgaggccagttggcgaggggtggctcctgagggtttttataccctttgtttgctaatgtttaattttgcatcataatttctacattgtccctgagtgtcagaactataatttattccatttctctctgtgtctgtgccaagaaacgcaggctctgggcctgccccttgcccaggaggccttgccagcctgtgtgcttgtgggaacaccttgtacctgagcttacaggtaccaataaagaggctttattttta

SEQ ID NO: 19 - DNA, 822 bp, Homo sapiens
gggcggcgagcaggcccgggagccgggaggctgcgggcggcggcgctggacccgacgcggcgagagaggccccgagatgccgagcaagaagaagaagtacaacgcgcggttcccgccggcgcggatcaagaagatcatgcagacggacgaagagattgggaaggtggcggcggcggtgcctgtcatcatctcccgggcgctcgagctcttcctagagtcgctgttgaagaaggcctgccaggtgacccagtcgcggaacgcgaagaccatgaccacatcccacctgaagcagtgcatcgagctggagcagcagtttgacttcttgaaggacctggtggcatctgttcccgacatgcagggggacggggaagacaaccacatggatggggacaagggcgcccgcaggggccggaagccaggcagcggcggccggaagaacggtgggatgggaacgaaaagcaaggacaagaagctgtccgggacagactcggagcaggaggatgaatctgaggacacagatactgatggggaagaggagacatcacaacccccaccccaggccagccacccctctgcccactttcagagccccccgacacccttcctgcccttcgcctctactctgcctttgcccccagcgcccccgggcccctcagcacctgatgaagaggacgaagaagattacgactcctagcgccttctgccccccagaccatagccccttttagttggttttagttgctctggggggaggagagaaggtagagctgttcttaaatttattaaaaaaaaaaataaaagggaatctcagtgtctgttcca

SEQ ID NO: 20 - DNA, 3137 bp, Homo sapiens
gagagatcccagcgcgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagta

SEQ ID NO: 21 - DNA, 4012 bp, Homo sapiens
attgctcccagcgccaagctctgtgtcgccgccgtcgcctaggcggttgggggtcggtggggcggcgcgggcgggggtcgctgcgcggggcggcgagcctctgttttgtctccttctctccctgtggagcggctcgggctgctggggaggccccggctccctccggacgctcggccaacggcggcggctagtccgcggccctgctgagagggaaaaggacgccgcggtcttcccaggcgtcgcggagagcagttccaaagaactactggttcagattttagctcttcccaagttgtgaaaatagtgaaggatgcttagactacttaacatacaaactgctttctggttaatcatctttagaagactggatttctggatatctactccactccatctctattgacttttaaaacatgataatgcaaacctataacactggcaaccatcagtgaacctttaatttcattgattaatagcgtttgaagcttcctcagggaataacaatgacatcagcagtggttgacagtggaggtactattttggagctttccagcaatggagtagaaaatcaagaggaaagtgaaaaggtttctgaatatccagcagtgattgtggagccagttccaagtgccagattagagcagggctatgcagcccaggttctggtttatgatgatgagacttatatgatgcaagatgtggcagaagaacaagaagttgagaccgagaatgtggaaacagtggaagcatcagttcacagcagtaatgcacactgtacagataagacaattgaagctgctgaagccctgcttcatatggaatctcctacctgcttgagggattcaagaagtcctgaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgattttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaatttatcttctgttttggtctctggtgatattttaaacaatatttaaaagtcagtatagaagtgttttagttaggaagtgataaaacatctctcttctccttcccaactactgcatgaagaaattctacttccattatattaatatttggcaaatatctgcatgttgccagtttctttctaattatgatgaactataatgttctgcttaacgtaatgaatttagtattttagttggctgcacttaaagaatttatatttgtaaaacactttaaaccatttgtttcacaatcagaccttttgtggattaaaaagaacaattactcttctagcccttttacagattaggaagttaaggtatctgaaggattacataaactatgtaattttactactgtctgtcactccatatcttaatgctctttctactacaaagaaaagttatctatttttacatgttttagaaatgtagatgaactcatacataatattttttgtcttttaattgatcacatactacttaggtcagaaattgtttataacagttccctttgtaatcttttaaacttttccataaatatattgatgatacttttatacaaaagctcaaagaaaaactcacttgattattttcccatttgggagttac

SEQ ID NO: 22 - DNA, 2595 bp, Homo sapiens
gcacaacttgtgaagaagcgaacacttccatggattgtccttggacttagggcgccctgcccgccttttgcagaggagaaaaaacttttttttttttttgcctcccccgagaactttccccccttctcctccctgcctctaactccgatccccccacgccatctcgccaaaaaaaaaaaaaaaaaaaaaaaagaaaaaaaaagaaaaaaaaagaaaaaaaattaccccaatccacgcctgcaaattcttctggaaggattttcccccctctcttcaggttgggcgcgtttggtgcaagattctcgggatcctcggctttgcctctccctctccctcccccctcctttcctttttcctttcctttcctttctttcttcctttccttccccccacccccacccccaccccaaacaaacgagtccccaattctcgtccgtcctcgccgcgggcagcgggcggcggaggcagcgtgcggcggtcgccaggagctgggagcccagggcgcccgctcctcggcgcagcatgttccagccggcgcccaagcgctgcttcaccatcgagtcgctggtggccaaggacagtcccctgcccgcctcgcgctccgaggaccccatccgtcccgcggcactcagctacgctaactccagccccataaatccgttcctcaacggcttccactcggccgccgccgccgccgccggtaggggcgtctactccaacccggacttggtgttcgccgaggcggtctcgcacccgcccaaccccgccgtgccagtgcacccggtgccgccgccgcacgccctggccgcccaccccctaccctcctcgcactcgccacaccccctattcgcctcgcagcagcgggatccgtccaccttctacccctggctcatccaccgctaccgatatctgggtcatcgcttccaagggaacgacactagccccgagagtttccttttgcacaacgcgctggcccgaaagcccaagcggatccgaaccgccttctccccgtcccagcttctaaggctggaacacgcctttgagaagaatcactacgtggtgggcgccgaaaggaagcagctggcacacagcctcagcctcacggaaactcaggtaaaagtatggtttcagaaccgaagaacaaagttcaaaaggcagaagctggaggaagaaggctcagattcgcaacaaaagaaaaaagggacgcaccatattaaccggtggagaatcgccaccaagcaggcgagtccggaggaaatagacgtgacctcagatgattaaaaacataaacctaaccccacagaaacggacaacatggagcaaaagagacagggagaggtggagaaggaaaaaaccctacaaaacaaaaacaaaccgcatacacgttcaccgagaaagggagagggaatcggagggagcagcggaatgcggcgaagactctggacagcgagggcacagggtcccaaaccgaggccgcgccaagatggcagaggatggaggctccttcatcaacaagcgaccctcgtctaaagaggcagctgagtgagagacacagagagaaggagaaagagggagggagagagagaaagagagagaaagagagagagagagagagagagagaaagctgaacgtgcactctgacaaggggagctgtcaatcaaacaccaaaccggggagacaagatgattggcaggtattccgtttatcacagtccacttaaaaaatgatgatgatgataaaaaccacgacccaaccaggcacaggacttttttgttttttgcacttcgctgtgtttcccccccatctttaaaaataattagtaataaaaaacaaaaattccatatctagccccatcccacacctgtttcaaatccttgaaatgcatgtagcagttgttgggcgaatggtgtttaaagaccgaaaatgaattgtaattttcttttccttttaaagacaggttctgtgtgctttttattttgattttttttcccaagaaatgtgcagtctgtaaacactttttgataccttctgatgtcaaagtgattgtgcaagctaaatgaagtaggctcagcgatagtggtcctcttacagagaaacggggagcaggacgacgggggggctgggggtggcgggggagggtgcccacaaaaagaatcaggacttgtactgggaaaaaaacccctaaattaattatatttcttggacattccctttcctaacatcctgaggcttaaaaccctgatgcaaacttctcctttcagtggttggagaaattggccgagttcaaccattcactgcaatgcctattccaaactttaaatctatctattgcaaaacctgaaggactgtagttagcggggatgatgttaagtgtggccaagcgcacggcggcaagttttcaagcactgagtttctattccaagatcatagacttactaaagagagtgacaaatgcttccttaatgtcttctataccagaatgtaaatatttttgtgttttgtgttaatttgttagaattctaacacactatatacttccaagaagtatgtcaatgtcaatattttgtcaataaagatttatcaatatgccctca

SEQ ID NO: 23 - DNA, 2274 bp, Homo sapiens
gtcagctggaggaagcggagtaggaagcggccgcgatgtccttttgtgtcctacaagcagccggcggcgccgccgagtgaggggacgcggcgcggtggggcggcgcggcccgaggaggcggcggaggaggggccgcccgcggcccccggctcactccggcactccgggccgctcggcccccatgcctgcccgaccgcgctgccggagccccaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccaggggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttggctgtacagagactctattttaatgtatatttgctgcaaagagaaaccgcttttggttttaaacctttaatgagaaaaaaatatataataccgagctcaaaaa

SEQ ID NO: 24 - DNA, 3668 bp, Homo sapiens
ggttacttcctccagagactgacgagtgcggtgtcgctccagctcagagctcccggagccgcccggccagcgtccggcctccctgatcgtctctggccggcgccctcgccctcgcccggcgcgcaccgagcagccgcgggcgccgagcagccaccgtcccgaccaagcgccggccctgcccgcagcggcaggatgaatgatttcggaatcaagaatatggaccaggtagcccctgtggctaacagttacagagggacactcaagcgccagccagcctttgacacctttgatgggtccctgtttgctgtttttccttctctaaatgaagagcaaacactgcaagaagtgccaacaggcttggattccatttctcatgactccgccaactgtgaattgcctttgttaaccccgtgcagcaaggctgtgatgagtcaagccttaaaagctaccttcagtggcttcaaaaaggaacagcggcgcctgggcattccaaagaacccctggctgtggagtgagcaacaggtatgccagtggcttctctgggccaccaatgagttcagtctggtgaacgtgaatctgcagaggttcggcatgaatggccagatgctgtgtaaccttggcaaggaacgctttctggagctggcacctgactttgtgggtgacattctctgggaacatctggagcaaatgatcaaagaaaaccaagaaaagacagaagatcaatatgaagaaaattcacacctcacctccgttcctcattggattaacagcaatacattaggttttggcacagagcaggcgccctatggaatgcagacacagaattaccccaaaggcggcctcctggacagcatgtgtccggcctccacacccagcgtactcagctctgagcaggagtttcagatgttccccaagtctcggctcagctccgtcagcgtcacctactgctctgtcagtcaggacttcccaggcagcaacttgaatttgctcaccaacaattctgggactcccaaagaccacgactcccctgagaacggtgcggacagcttcgagagctcagactccctcctccagtcctggaacagccagtcgtccttgctggatgtgcaacgggttccttccttcgagagcttcgaagatgactgcagccagtctctctgcctcaataagccaaccatgtctttcaaggattacatccaagagaggagtgacccagtggagcaaggcaaaccagttatacctgcagctgtgctggccggcttcacaggaagtggacctattcagctgtggcagtttctcctggagctgctatcagacaaatcctgccagtcattcatcagctggactggagacggatgggagtttaagctcgccgaccccgatgaggtggcccgccggtggggaaagaggaaaaataagcccaagatgaactacgagaagctgagccggggcttacgctactattacgacaagaacatcatccacaagacgtcggggaagcgctacgtgtaccgcttcgtgtgcgacctccagaacttgctggggttcacgcccgaggaactgcacgccatcctgggcgtccagcccgacacggaggactgaggtcgccgggaccaccctgagccggccccaggctcgtggactgagtgggaagcccatcctgaccagctgctccgaggacccaggaaaggcaggattgaaaatgtccaggaaagtggccaagaagcagtggccttattgcatcccaaaccacgcctcttgaccaggctgcctcccttgtggcagcaacggcacagctaattctactcacagtgcttttaagtgaaaatggtcgagaaagaggcaccaggaagccgtcctggcgcctggcagtccgtgggacgggatggttctggctgtttgagattctcaaaggagcgagcatgtcgtggacacacacagactatttttagattttcttttgccttttgcaaccaggaacagcaaatgcaaaaactctttgagagggtaggagggtgggaaggaaacaaccatgtcatttcagaagttagtttgtatatattattataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaagggccgactaagagaagttgtaaagtatgtattatttacatttaatagacttacagggataaggcctgtggggggtaatccctgctttttgtgtttttttgtttgtttgtttgtttgtttttggggggttttcttgccttggttgtctggcaaggactttgtacatttgggagtttttatgagaaacttaaatgttattatctgggcttatatctggcctctgctttctcctttaattgtaaagtaaaagctataaagcagtatttttcttgacaaatggcatatgttttccacttctttgcatgcgtttaagtcagtttatacacaaaatggattttattttttagtttaactgtgtttctccgacagctcacctctctctgaccacccagccatttccttcctgtgctccacgttcttctgtgtgattaaaataagaatattatttttggaaatatgcaactccttttcagagatcaggagggatttatgtagcagctatttttactgcaaaagtaattcactggaaaaaaaatgtaatttgtaagaaagctttatttttatctcagctctatgtaaagttaaagttactgtacagagctgaaggacggggggcggtaggggtcttgatgaaacctcttgaacgaagcacagtttgtcccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcattcggagaaaacgttttgatcaaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgtgatgaaactgaggaatcgggtggccgggcaagctgggaagagcaaagccagagctgcgctgcctcaatacccacaaaagaccattcccagtatacataagcacaggatgtttttctcaagagggatgtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatggtaataaacagatcttaagtataaaaattttgtaattgggcctttactctctcaataataaagtattttgtttatataaa

SEQ ID NO: 25 - DNA, 2104 bp, Homo sapiens
aaccgcatctgcagcgagcatctgagaagccaagactgagccggcggccgcggcgcagcgaacgagcagtgaccgtgctcctacccagctctgctccacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 26 - DNA, 3775 bp, Homo sapiens
attcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgca

SEQ ID NO: 27 - DNA, 6713 bp, Homo sapiens
gtagtgactcatctcgggcagagcgctagggctccgagcgaaccagcgagcgagcgaacgagcggcgctcggcggggacagaaagagggagagagagagagagagagagggagaggcgcggccgggcgaggcgggcccgtccgggagcgggctccggggaaggggtgcgggtctgggcgccggagcggggagcggggccgcgtccctctcagcgccagctctacttgagccccacgagccgctgtccccctggcgcgctcggggccgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattaagatcccccgtggagaaagcagtgacacattcacacagctgttccctcgcatgttatttcatgaacatgacctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctgtttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccatttattttagtttgtgtttacttgattttgaggaagaaaatatttgactttgtgtaaagagtagggtatcagggtgtcttttctgccgtgggagatgtgtatatatatagtattttggtgtatagtagaaaataagctttgtgcatctgtatttgagatatgttaatgacgtggagtaaagtcagctgtaagactctggaggcaaacaagttgtatatggttcatatggctctatggggaatttaattacctttctgggcactttttttttttttttttttttaagtaatggtgaaatggtcccattggagagtctcctaaatagaccttccaggcagaaccgcaagctcaaaatctttgtatagttttgaaaattgaggagtagctttgtttggaagcctttctggtggtggtttttgttgttgttgttgttttgttgttttactatatgtaatacaagcctacagtatttgcactaaagaaagcttgttagaaaaagcttgctgctatggaagaaagaacatattaaaacttctttcccttgcgatttttttgggggaggggggttagcatttccactttcagttgagtagcattttgtagaataaaatgaattaagattgaagagcc

SEQ ID NO: 28 - DNA, 1443 bp, Homo sapiens
aagtgtgccggcgtcgcgcgaaggttcagcagggagccgtgggccgggcgcgccggttcccggcacgtgtctcggcacgtggcagcgcgcctggccctgggcttggaggcgccggcgccctggatccgccggccgtggtcgccgagtcggtgtcgtccttgaccatcgccgacgcgttcattgcagccggcgagagctcagctccgaccccgccgcgccccgcgcttcccaggaggttcatctgctccttccctgactgcagcgccaattacagcaaagcctggaagcttgacgcgcacctgtgcaagcacacgggggagagaccatttgtttgtgactatgaagggtgtggcaaggccttcatcagggactaccatctgagccgccacattctgactcacacaggagaaaagccgtttgtttgtgcagccaatggctgtgatcaaaaattcaacacaaaatcaaacttgaagaaacattttgaacgcaaacatgaaaatcaacaaaaacaatatatatgcagttttgaagactgtaagaagacctttaagaaacatcagcagctgaaaatccatcagtgccagcataccaatgaacctctattcaagtgtacccaggaaggatgtgggaaacactttgcatcacccagcaagctgaaacgacatgccaaggcccacgagggctatgtatgtcaaaaaggatgttcctttgtggcaaaaacatggacggaacttctgaaacatgtgagagaaacccataaagaggaaatactatgtgaagtatgccggaaaacatttaaacgcaaagattaccttaagcaacacatgaaaactcatgccccagaaagggatgtatgtcgctgtccaagagaaggctgtggaagaacctatacaactgtgtttaatctccaaagccatatcctctccttccatgaggaaagccgcccttttgtgtgtgaacatgctggctgtggcaaaacatttgcaatgaaacaaagtctcactaggcatgctgttgtacatgatcctgacaagaagaaaatgaagctcaaagtcaaaaaatctcgtgaaaaacggagtttggcctctcatctcagtggatatatccctcccaaaaggaaacaagggcaaggcttatctttgtgtcaaaacggagagtcacccaactgtgtggaagacaagatgctctcgacagttgcagtacttacccttggctaagaactgcactgctttgtttaaaggactgcagaccaaggagcgagctttctctcagagcatgcttttctttattaaaattactgatgcagaacatttgattccttatcatttccatggtctttgttcaaagtgtctctttcctgggtctcttgagtttctttatatgccttctcctcatttttgctgaaagcacgaagaacacacattaaagcttttcctccttgaa

SEQ ID NO: 29 - DNA, 3946 bp, Homo sapiens
agtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccagg

SEQ ID NO: 30 - DNA, 3257 bp, Homo sapiens
gctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagccaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcacgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccacagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaataccaa

SEQ ID NO: 31 - DNA, 1830 bp, Homo sapiens
gggaccttgagagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcagggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtgtgtgtttgttctttttattgaatctatttaagtaaaaaaaaaattggttctttattaa

SEQ ID NO: 32 - DNA, 1929 bp, Homo sapiens
aggagccgccgccagtggagggccgggcgctgcggccgcggccggggcgggcgcagggccgagcggacgggggggcgcgggccccccgggaggccgcggccactcccccccgggccggcgcggcgggggaggcggaggatggaaacacccttctacggcgatgaggcgctgagcggcctgggcggcggcgccagtggcagcggcggcagcttcgcgtccccgggccgcttgttccccggggcgcccccgacggccgcggccggcagcatgatgaagaaggacgcgctgacgctgagcctgagtgagcaggtggcggcagcgctcaagcctgcggccgcgccgcctcctacccccctgcgcgccgacggcgcccccagcgcggcaccccccgacggcctgctcgcctctcccgacctggggctgctgaagctggcctcccccgagctcgagcgcctcatcatccagtccaacgggctggtcaccaccacgccgacgagctcacagttcctctaccccaaggtggcggccagcgaggagcaggagttcgccgagggcttcgtcaaggccctggaggatttacacaagcagaaccagctcggcgcgggcgcggccgctgccgccgccgccgccgccgccggggggccctcgggcacggccacgggctccgcgccccccggcgagctggccccggcggcggccgcgcccgaagcgcctgtctacgcgaacctgagcagctacgcgggcggcgccgggggcgcggggggcgccgcgacggtcgccttcgctgccgaacctgtgcccttcccgccgccgccacccccaggcgcgttggggccgccgcgcctggctgcgctcaaggacgagccacagacggtgcccgacgtgccgagcttcggcgagagcccgccgttgtcgcccatcgacatggacacgcaggagcgcatcaaggcggagcgcaagcggctgcgcaaccgcatcgccgcctccaagtgccgcaagcgcaagctggagcgcatctcgcgcctggaagagaaagtgaagaccctcaagagtcagaacacggagctggcgtccacggcgagcctgctgcgcgagcaggtggcgcagctcaagcagaaagtcctcagccacgtcaacagcggctgccagctgctgccccagcaccaggtgcccgcgtactgagtccgcgcgcggggcgcatgcgcggccaccctccccaaggggcgggctcgcgggggggtgtcgtgggcgccccggacttggagagggtgcggccctggggaccccccctccccgagtgtgcccaggaactcagagagggcgcggcccccggggattccccccccccgagggtgcccaggactcgacaagctggaccccctgctcccgggggggcgagcgcatgacccccccgccctcgcgctgcctctttcccccgcgcggccgccccgtgttgcacaaacccgcgcgtctcggctgcccctttgtacaccgcgccgcggaagggggctccgagggggcgcagcctcaaaccctgcctttcctttacttttacttttttttttttttctttggaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctccccccttcggttctttcgaccggtcccccctcccttttttgttctgttttgttttgttttgctacgagtccacattcctgtttgtaatccttggttcgcccggttttctgttttcagtaaagtctcgttacgccagctcggctctccgcctccttcttcccccgccggggcctggcgggctgggcggggcctggttcgctt

SEQ ID NO: 33 - DNA, 2915 bp, Homo sapiens
gcagacggcgctgagcgcggcggcggcgggagcggcgtcgagtgtctccgtgcgcccgtctgtggccaagcagccagcagcctagcagccagtcagcttgccgccggcggccaagcagccaaccatgctcaacttcggtgcctctctccagcagactgcggaggaaagaatggaaatgatttctgaaaggccaaaagagagtatgtattcctggaacaaaactgcagagaaaagtgattttgaagctgtagaagcacttatgtcaatgagctgcagttggaagtctgattttaagaaatacgttgaaaacagacctgttacaccagtatctgatttgtcagaggaagagaatctgcttccgggaacacctgattttcatacaatcccagcattttgtttgactccaccttacagtccttctgactttgaaccctctcaagtgtcaaatctgatggcaccagcgccatctactgtacacttcaagtcactctcagatactgccaaacctcacattgccgcacctttcaaagaggaagaaaagagcccagtatctgcccccaaactccccaaagctcaggcaacaagtgtgattcgtcatacagctgatgcccagctatgtaaccaccagacctgcccaatgaaagcagccagcatcctcaactatcagaacaattcttttagaagaagaacccacctaaatgttgaggctgcaagaaagaacataccatgtgccgctgtgtcaccaaacagatccaaatgtgagagaaacacagtggcagatgttgatgagaaagcaagtgctgcactttatgacttttctgtgccttcctcagagacggtcatctgcaggtctcagccagcccctgtgtccccacaacagaagtcagtgttggtctctccacctgcagtatctgcagggggagtgccacctatgccggtcatctgccagatggttccccttcctgccaacaaccctgttgtgacaacagtcgttcccagcactcctcccagccagccaccagccgtttgcccccctgttgtgttcatgggcacacaagtccccaaaggcgctgtcatgtttgtggtaccccagcccgttgtgcagagttcaaagcctccggtggtgagcccgaatggcaccagactctctcccattgcccctgctcctgggttttccccttcagcagcaaaagtcactcctcagattgattcatcaaggataaggagtcacatctgtagccacccaggatgtggcaagacatactttaaaagttcccatctgaaggcccacacgaggacgcacacaggagaaaagcctttcagctgtagctggaaaggttgtgaaaggaggtttgcccgttctgatgaactgtccagacacaggcgaacccacacgggtgagaagaaatttgcgtgccccatgtgtgaccggcggttcatgaggagtgaccatttgaccaagcatgcccggcgccatctatcagccaagaagctaccaaactggcagatggaagtgagcaagctaaatgacattgctctacctccaacccctgctcccacacagtgacagaccggaaagtgaagagtcagaactaactttggtctcagcgggagccagtggtgatgtaaaaatgcttccactgcaagtctgtggccccacaacgtgggcttaaagcagaagccccacagcctggcacgaaggccccgcctgggttaggtgactaaaagggcttcggccacaggcaggtcacagaaaggcaggtttcatttcttatcacataagagagatgagaaagcttttattcctttgaatattttttgaaggtttcagatgaggtcaacacaggtagcacagattttgaatctgtgtgcatatttgttactttacttttgctgtttatacttgagaccaacttttcaatgtgattcttctaaagcactggtttcaagaatatggaggctggaaggaaataaacattacggtacagacatggagatgtaaaatgagtttgtattattacaaatattgtcatctttttctagagttatcttctttattattcctagtctttccagtcaacatcgtggatgtagtgattaaatatatctagaactatcatttttacactattgtgaatatttggaattgaacgactgtatattgctaagagggcccaaagaattggaatcctccttaatttaattgctttgaagcatagctacaatttgtttttgcatttttgttttgaaagtttaacaaatgactgtatctaggcatttcattatgctttgaactttagtttgcctgcagtttcttgtgtagatttgaaaattgtataccaatgtgttttctgtagactctaagatacactgcactttgtttagaaaaaaaactgaagatgaaatatatattgtaaagaagggatattaagaatcttagataacttcttgaaaaagatggcttatgtcatcagtaaagtacctttatgttatgaggatataatgtgtgctttattgaattagaaaattagtgaccattattcacaggtggacaaatgttgatgttgtcctgttaatttataggcgttttttggggatgtggaggtagttgggtagaaaaattattagaacattcacttttgttaacagtatttctcttttattctgttatatagtggatgatatacacagtggcaaaacaaaagtacattgcttaaaatatatagtgaaaaatgtcactatatcttcccatttaacattgtttttgtatattgggtgtagatttctgacatcaaaacttggacccttggaaaacaaaagttttaattaaaaaaaatccttgtgacttacaatttgcacaatatttcttttgttgtactttatatcttgtttacaataaagaattccctttggta

SEQ ID NO: 34 - DNA, 5201 bp, Homo sapiens
cttactcatttgtgtttattcttggacttatcctgacataatggggtttttttaattatagattcacactgcatttattcatcacccctgtcctctcatccataactcaaatttactaccagcaacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaaggccgttctgactggcagggggagaaagtaaacagagttgaatcaccctccccactggccaattggagggggtttggtttgtgacgtgatgggattctgcgaaattgttactgagcaagagaatgccggaacggtgcggaccggccggagcaggggttcagaagccgtcagtggactcgggaaaaagtgtctcttagacctggcgctcggcgggaccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcgcctcggcgctcctgcgagtcggaagcgccccgcgcccccgcccccttggccgccgcgccgtgccgcgccgcgccgcgctcgtcgtccgaggccagggcagggcgagccgaacctccgcagccaccgccaagtttgtccgcgccgcctgggctgccgtcgcccgcaccatgtccgcggccgcctacatggacttcgtggctgcccagtgtctggtttccatttcgaaccgcgctgcggtgccggagcatggggtcgctccggacgccgagcggctgcgactacctgagcgcgaggtgaccaaggagcacggtgacccgggggacacctggaaggattactgcacactggtcaccatcgccaagagcttgttggacctgaacaagtaccgacccatccagaccccctccgtgtgcagcgacagtctggaaagtccagatgaggatatgggatccgacagcgacgtgaccaccgaatctgggtcgagtccttcccacagcccggaggagagacaggatcctggcagcgcgcccagcccgctctccctcctccatcctggagtggctgcgaaggggaaacacgcctccgaaaagaggcacaagtgcccctacagtggctgtgggaaagtctatggaaaatcctcccatctcaaagcccattacagagtgcatacaggtgaacggccctttccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggagaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgggggggaggggggtaaggccaagactggggtagaattttaaagattcaacactggtgtacatatgtccgctgggtgagttgacctgtggcctcgcacagtgattctgggccctttatgcttgctgtctctcagaattgttttcttaccttttaatgtaatgacgagtgtgcttcagtttgtttagcaaaaccactctcttgaatcacgttaacttttgagattaaaaaaaaaaacgccatagcacagctgtctttatgcaagcaagagcacatctactccagcatgatctgtcatctaaagacttgaaaacaaaaaacagttacttatagtcaatgggtaagcagagtctgaatttatactaatcaagacaaacctttgaaaggttacactaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatggcagagatgtgagggcagaatatacacaacagatgctgaaggagaaggagggtagtgttttgcaaaagaaaaagaaaagaaccaacagaattttaactctattaacttttccaaattttcctatgcttttagttaacatcattattgtatcctaatgccactaggggagagagcttttgactctgttgggttttatttgaatgtgtgcataacagtaatgagatctggaaacacctattttttggggaaaaaggtttgttggtctccttcctgtgttcctacaaaactcccactctcaggtgcaagagttatgtagaaggaaagggagctgaaataggaacagaaaaatcaacccctataactagtgaacaccaagggaaaataccacaatgatttcagaggagactctgcaaaatcgtcccttgtggagaatgcaggcaacatggaatactaggaatgaaatcacatcactgtatcttttacatcaatagcctcaccactaatatatcttgtatctaggtgtctataatggctgaaaccactacatccatctatgccatttacctgaaaacttaactgtggcctttatgaggccagaaaagtgaactgagttttcgtagttaagacctcaaatgaggggagtcagcagtgatcatgggggaaatgtttacattttttttttcttcagaagtaacgctttctgatgattttatctgatatttaaaacagggagctatggtgcactctagtttatacttgcgctctgaaatgtgtaaacatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagttgtattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcaacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacaatttacttcccaaaaaagttgttacttgccttttcaagttgttgacaaacacacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatagtaatttttgtttacttttttaaccaaactgaatttttgaaagactattgcaggtgtttaaaaagaaagaaaagttgttttatctaatactgtaagtagttgtcatattctggaaaatttaatagttttagagttaagatatctcctctctttggttagggaagaagaaagcccttcaccattgtggaatgatgccctggctttaaggtttagctccacatcatgcttctcttgagaattctatttggtagttacaattacagaaactgattagtttgtcagtttgcagatagatttagcacagtactcatcactcggatagattgagatgttctttcacatcagatgatctgtaacactgtaagatactgatctttacaactgtttaatcagttttatttttgtacagtattagtgacctaagttattttgctgtcccgtttttgtaaatcaaatgaaattataaaagaggattctgacagtaggtattttgtacatatgtatatatgttgtccaaataaaaataataaatgataaa

SEQ ID NO: 35 - DNA, 5582 bp, Homo sapiens
gggtgggcggagcgggccccccgagcgggggctggcgagcgcggggagggggccgaaagggcggcaaagccggcgcgcgcccggctgggggcggagggcgggggcccgcgggccggaacagccgcggcaagtggcggcggcggcagcggcagcggaggcagctgaggcggcggcggcgagtgggggtccgggcggcggcggcgggcccggcggcgggccgaggagccgggcgcaatggagcggaagagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccagctcttctgggagaagaagctgagcggcctgaacgccttcgacattgctgaggagctggtcaagaccatggacctccccaagggcctgcagggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcatgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttggagcctggagttcggtgcgtccgctagactttggtgcccacgtttgagcttctgtctttggttgggtgatgaaaggctgaaagcggtgtggggacagggccagcaggtcccccaacctcgcggacattcacaacccaagagtcaggcttaggggtattcagagaagaccaggccggcctgggcatctgtgggcaagggccgtgccccctgaggtgccgctggctcagcctagggatcgtgggtcttggccctgctgccccggtgaggaagatgggctggggctcagacccagcaccgctccttccaaaggaagggaagcaggaggggctgcctggcagggagggccccccaggtcctcaggtcctgcacagccgctgcagggaggggagctgtgccccgggaccctggacttcagctcactagccatggccactggaagctgctttctggacctgaaggctgggaggccaccctcccctcatctgcccggcactcagagacactctgtttccctcttcccatctcccactgtgtccctgtctcccttggtctctctctgtctctgtctatccctgtctctatctctccctcttgtctctctcttgcgccgtctccctctctgtccctctttgtttcttgctctctctcctgtctctctccctcggtctctgtctctgtctcttgctgtctctccctctctgtcgcagcccagcttcctgtcactgacagaccccgatcagtccctctgatcccggggttctggccatgtcctggccttggtctgagatgtgatgatccctacccctgccacagggccctccccactggaagcccatccaggccctgggctgtcgctgttgacgaagcttgagggtcctttcctctctccctgaaaccttggggacccccacaggccaaggcaatactggcctttgctagaggtcgtgcccggtgagaagtgagttgtaggcgtgggcacctgaggggccagcccagtgctcaggccctcgtcaaattccctgccctggaaaagtctcagaccctcaggctgaaccccctgggcgcaccgaggctccacactccagccccagaacccagacctggcatggggcggggaagcctgagctcccaatgctgggatctttcgtgggggcctcatgaccagcctgccctgtgcggtgcctggccccatcctcaaaggccacttggctgcccccagccccgcccatgtctcagccccaagaccttctgggactttttttttttttagacaagagtttcgctcttctttcgctcttgttgcacaggctggagtgcagtggcgtgatctgggctcactgcaacctccaccttctgggttcaagcctcagcctcccgagtagccaccacgcccagctaatttttgtatttttaatagagacagggtttcaccatgttggccagtctggtctggaactcctaacctcaggtgatccgcccgccccagcttcccaaattgccgggattacaggtgtgaaccaccatggcagcccttctggcacttgccagcagcagcaagagcctcacgtgtcccccgcctcccctcagaccaagctccccaccgctgccgccacagagggtaccagggaggagaggctcaggacccccgtggcgaggatgcacctcccagccctcggcccagccacacggaccacagggctcccgagtctcagcaacaccagctaaggggcatcatgcctctcctgccacacccagggcccgtgccttgctgtccctgcagcccccagacccaggcagacagggacagcccttctgaccaccgcacacactcgccaccgcaaagatccccggggatgcccctcgcctgtgtgtgtccctcatggctgtcacagcaaatctccaggagcccggaggtgcccatggaaaacacccccagcttccggaacgttctttcggacagggccataccggagcaagactcagctttctggtagcgggtggctgggcactgcctgtgagattctgtcacactcgctccagattcaaggggtccaaaaagtgtaaacaagtcaagtgcccatccagggatgaacgaacacagcccggcccggccacaccatggagcaggactcggccatgaacaggaaccaggctctgacaccggccacggcgcagatgcccctggaggagtccaccctcagcaagagacacacagacaccgacacggcgtgcaatcccatttgtgtgaatgtccaggacaggccgattcagagacaggaaggggacacgtgggtgccagtgactggggattatggggactgggggaaatggctaaagggcacccacaaaagttaatgataatgttccacagttttttttttgagatggagtctcactcttgtcacccaggctggagtgcaatggtgtgatctctgctcactgcaagctctgcctcctgggttcacgccattctccctcctcagcctcccaagtagctgagattacaggcatatgccaccacccccagtagagacggggtttcaccatgttagccaggctggtcacgaactcctgacctcaagtgatcccccacctcggcctcccaaagtgctgggattacaggcatgagccaccgtgcctcaccagaattgtgtacttttttttcttcttcttcttcggcatggagtttcgctcttgttgcccaggctggagtgcaatggtgcaaacttggctcaccgcaacctcctcctcccgggttcaatagattctccagcctcagcctgctgagtagctgagattacgggcgcccgccaccacacccagctaatctttgtacttttagtagagacagggtttcaccatgttggccacgggcaaaagaattttgttgagggcaaataatatgagaccacaaaactgccttccctgctcagttttaattttcacagttttaatttttagccttctctggttaccaaaataaccacgctcacggccgttcatttgaagatatttccagttaacgtgtgtgaagtgggttttttgagatgtaatttacaagcaataaaatgctcctgtctctgc

SEQ ID NO: 36 - DNA, 4839 bp, Homo sapiens
aagcggaggctccgagctctaggccggccggcggtggcggcggcgaggccgggactcgggcttagggcctgctgtggaggcagcggcggacgccgagctaagcagtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacaggtgcctagtggggaggaccagacggccctgtccctggaagagtgccttaggctgctggaagccacctgcccctttggggagaatgctgagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaaggaaggaacccccccccccccgaaaaaaaaatcaaagcgggaagaaaatcagagggaaggttaaggttggctctggccaggattccaggcagcaggttggagtgactggtgggcctagatcactggtgtgataaaccccaattttcaccccggggggggtggggtacacagacacagggtgggggtggggagggacggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaagtgcactttttccccactttgaatttaaattgagaataaaggaaatggactcattgta

SEQ ID NO: 37 - DNA, 690 bp, Homo sapiens
ctccgccgccggctcccgggtgtggtggtcgcaccagctctctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgga

SEQ ID NO: 38 - DNA, 2630 bp, Homo sapiens
agagtgaaatattactgccgagggaacgtagcagggcacacgtctcgcctctttgcgactcggtgccccgtttctccccatcacctacttacttcctggttgcaacctctcttcctctgggacttttgcaccgggagctccagattcgccaccccgcagcgctgcggagccggcaggcagaggcaccccgtacactgcagagacccgaccctccttgctaccttctagccagaactactgcaggctgattccccctacacactctctctgctcttcccatgcaaagcagaactccgttgcctcaacgtccaacccttctgcagggctgcagtccggccaccccaagaccttgctgcagggtgcttcggatcctgatcgtgagtcgcggggtccactccccgcccttagccagtgcccagggggcaacagcggcgatcgcaacctctagtttgagtcaaggtccagtttgaatgaccgctctcagctggtgaagacatgacgaccctggactccaacaacaacacaggtggcgtcatcacctacattggctccagtggctcctccccaagccgcaccagccctgaatccctctatagtgacaactccaatggcagcttccagtccctgacccaaggctgtcccacctacttcccaccatcccccactggctccctcacccaagacccggctcgctcctttgggagcattccacccagcctgagtgatgacggctccccttcttcctcatcttcctcgtcgtcatcctcctcctccttctataatgggagcccccctgggagtctacaagtggccatggaggacagcagccgagtgtcccccagcaagagcaccagcaacatcaccaagctgaatggcatggtgttactgtgtaaagtgtgtggggacgttgcctcgggcttccactacggtgtgcacgcctgcgagggctgcaagggctttttccgtcggagcatccagcagaacatccagtacaaaaggtgtctgaagaatgagaattgctccatcgtccgcatcaatcgcaaccgctgccagcaatgtcgcttcaagaagtgtctctctgtgggcatgtctcgagacgctgtgcgttttgggcgcatccccaaacgagagaagcagcggatgcttgctgagatgcagagtgccatgaacctggccaacaaccagttgagcagccagtgcccgctggagacttcacccacccagcaccccaccccaggccccatgggcccctcgccaccccctgctccggtcccctcacccctggtgggcttctcccagtttccacaacagctgacgcctcccagatccccaagccctgagcccacagtggaggatgtgatatcccaggtggcccgggcccatcgagagatcttcacctacgcccatgacaagctgggcagctcacctggcaacttcaatgccaaccatgcatcaggtagccctccagccaccaccccacatcgctgggaaaatcagggctgcccacctgcccccaatgacaacaacaccttggctgcccagcgtcataacgaggccctaaatggtctgcgccaggctccctcctcctaccctcccacctggcctcctggccctgcacaccacagctgccaccagtccaacagcaacgggcaccgtctatgccccacccacgtgtatgcagccccagaaggcaaggcacctgccaacagtccccggcagggcaactcaaagaatgttctgctggcatgtcctatgaacatgtacccgcatggacgcagtgggcgaacggtgcaggagatctgggaggatttctccatgagcttcacgcccgctgtgcgggaggtggtagagtttgccaaacacatcccgggcttccgtgacctttctcagcatgaccaagtcaccctgcttaaggctggcacctttgaggtgctgatggtgcgctttgcttcgttgttcaacgtgaaggaccagacagtgatgttcctaagccgcaccacctacagcctgcaggagcttggtgccatgggcatgggagacctgctcagtgccatgttcgacttcagcgagaagctcaactccctggcgcttaccgaggaggagctgggcctcttcaccgcggtggtgcttgtctctgcagaccgctcgggcatggagaattccgcttcggtggagcagctccaggagacgctgctgcgggctcttcgggctctggtgctgaagaaccggcccttggagacttcccgcttcaccaagctgctgctcaagctgccggacctgcggaccctgaacaacatgcattccgagaagctgctgtccttccgggtggacgcccagtgacccgcccggccggccttctgccgctgcccccttgtacagaatcgaactctgcacttctctctcctttacgagacgaaaaggaaaagcaaaccagaatcttatttatattgttataaaatattccaagatgagcctctggccccctgagccttcttgtaaatacctgcctccctcccccatcaccgaacttcccctcctcccctatttaaaccactctgtctcccccacaaccctcccctggccctctgatttgttctgttcctgtctcaaatccaatagttcacagctga

SEQ ID NO: 39 - DNA, 2485 bp, Homo sapiens
agtcccagtggcggaggctacgaaacttgggggagtgcacagaagaacttcgggagcgcacgcgggaccagggaccaggctgagactcggggcgccagtccgggcaggggcagcgggagccggccggagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaa

SEQ ID NO: 40 - DNA, 2386 bp, Homo sapiens
agcccgcgcgctcgcagcttctcgctctcgcctgcctgcccgctcccttgcttgctcgcgctttcgctcgccctctcctcgaggatcgaggggactctgaccacagcctgtggctgggaagggagacagaggcggcggcggctcaggggaaacgaggctgcagtggtggtagtaggaagatgtcgggcgaggacgagcaacaggagcaaactatcgctgaggacctggtcgtgaccaagtataagatggggggcgacatcgccaacagggtacttcggtccttggtggaagcatctagctcaggtgtgtcggtactgagcctgtgtgagaaaggtgatgccatgattatggaagaaacagggaaaatcttcaagaaagaaaaggaaatgaagaaaggtattgcttttcccaccagcatttcggtaaataactgtgtatgtcacttctcccctttgaagagcgaccaggattatattctcaaggaaggtgacttggtaaaaattgaccttggggtccatgtggatggcttcatcgctaatgtagctcacacttttgtggttgatgtagctcaggggacccaagtaacagggaggaaagcagatgttattaaggcagctcacctttgtgctgaagctgccctacgcctggtcaaacctggaaatcagaacacacaagtgacagaagcctggaacaaagttgcccactcatttaactgcacgccaatagaaggtatgctgtcacaccagttgaagcagcatgtcatcgatggagaaaaaaccattatccagaatcccacagaccagcagaagaaggaccatgaaaaagctgaatttgaggtacatgaagtatatgctgtggatgttctcgtcagctcaggagagggcaaggccaaggatgcaggacagagaaccactatttacaaacgagacccctctaaacagtatggactgaaaatgaaaacttcacgtgccttcttcagtgaggtggaaaggcgttttgatgccatgccgtttactttaagagcatttgaagatgagaagaaggctcggatgggtgtggtggagtgcgccaaacatgaactgctgcaaccatttaatgttctctatgagaaggagggtgaatttgttgcccagtttaaatttacagttctgctcatgcccaatggccccatgcggataaccagtggtcccttcgagcctgacctctacaagtctgagatggaggtccaggatgcagagctaaaggccctcctccagagttctgcaagtcgaaaaacccagaaaaagaaaaaaaagaaggcctccaagactgcagagaatgccaccagtggggaaacattagaagaaaatgaagctggggactgaggtgggtcccatctccccagcttgctgctcctgcctcatccccttcccaccaaaccccagactctgtgaagtgcagttcttctccacctaggaccgccagcagagcggggggatctccctgcccccaccccagttccccaacccactcccttccaacaacaaccagctccaactgactctggtcttgggaggtgaggcttcccaaccacggaagactactttaaatgaaaaaaagaaattgaataataaaatcaggagtcaaaattcatcgtcttcaagcccctctttctagccttttctactactctctgcttggtcaaggtttgtgccccactacagaacagggctaaattagccaccaccactgaaaactcagccgaatttttttataccactctgatgtcagcattttttccatctgtttggggctttttcctcttttttccattctccccaaatattttatctggcttcaaaattaagaggattatttttcagattgtttttattcagtgtggccgattcctcatctgattcaggctgtccagtcaggcccctcccattttaggagctggagccttcatttatgaagagattctcatctatgaaatggatcctcatttgtaaatcttttttcttccattttcacaaagctgtaaagaaataatccatctcaaccttaccctttttctctggagtcagtggggtctttcctcgctccatcttacacagacctgagctggaagctcaactggttttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacattaaaataaatttggatttgctcataatga

SEQ ID NO: 41 - DNA, 4460 bp, Homo sapiens
attcgacagtccccgctctgagagggagggacagagagcgaactgtcagatcggagcgagagcgggcgcccgagagagggagagagagagagggagggagaggaaaagtgagagagggaaagagagcgcgaacgagggcgcagagcgagctcctgctgcaactctgctccagcacggccagcgccagcgcccgccgtcggtgcactctacgagccgtgcagcgtgcccactggagttgttgtgtatcaaggatcgatcccctatatgcacacacacacctccacctccaccaatgcactcttcttcctcctccttctccagacaactgctgggaaaaaaataaaacaccaaccccaaccgtcagcaacaaggtaacagagcgattcgacatcattttttttcctgttcaattttttccttgttatatttgtttcctaatttctgcccaaaaggaaagatgtcgcatcagactgtgactgttgcgaggagaatgaaaaaggactcttgtttcagaggcaaccaagagctccggcaatagcaacttcagagaaatgcaccatcgcaagaagttttcctaggacagaacaaaacttgaaacgagaggaccagagggggagagcaggagccagcctcccctctccgcactcgcgagcagccagcagcaccacgccttcaaggacgaaaaagttttactactctaagggaaaacgagtgaaatgtgttcctgaggaggagaggagaggagaggagagagcggacaagagaaggagcgggccggttgctggtcatccgtaatttggctaaggaagaaaggagcagcttctttctttgttatctcccgtgaaaccttcacttagcaggtggacggagccccgcgaccgggcagagtccgggctcgcccgaggacaggaggaggagcgggagcccgcgcgtcccgggagagcgccccgagtgcaggtccccgccccgcccggcgagccccgctggagcgagcccagcgcgccggggctggggggcggccacgaccccccctgaagggggtggccacggagcgcaccccgagaagcgagcccccctccccagagcgctgctcctgcggctgctgctgctgctggtgaccaaggccggccggcgacccccgcgccctgccgagcggccttgcagctgcagccgggggccgcggcggcggcggcggcggcgggggcggaggcggcggcggaggaggaggcggcgaaggcggcggggccggcgggggcccggggcgggggcggggaaggagggggggaggaggcgggaggcggggggcgcggcggcggcggcggcggcggcggccgcggctgctgctgcggcggcggcggcggtggtggcggcggtggggtggcgggagcggagcggcatggccacggcggcttctaacccctacctgccggggaacagcctgctcgcggccggctctattgtgcactcggacgcggcaggggctggcggcggcgggggtggcggcggcggcggcggcgggggcggcgcagggggcgggggcggcggcatgcagccgggcagcgccgccgtgacctcgggcgcctaccggggggacccgtcctctgtcaagatggtccagagcgacttcatgcagggggccatggccgccagcaacggcggccatatgctgagccacgcgcaccagtgggtcacagccctgccccacgccgccgccgccgccgccgctgccgccgccgccgccgtggaggcgagctcgccgtggtcgggcagcgccgtgggcatggctggcagcccccagcagccaccgcagccgccgccgccaccgccgcagggccccgacgtgaagggcggcgccgggcgcgacgacctgcacgcgggcacagcgctgcaccaccgcgggccgccgcacctcggacccccgccgccgcccccacaccagggccaccctgggggctggggggcggccgccgctgccgcagccgcagccgccgccgccgccgccgccgcgcacctcccgtccatggccgggggccagcagccgccgccgcagagtctgctctactcgcagcccggaggcttcacggtgaacggcatgctgagcgcgccaccggggcccggcggcggcggcggcggcgcgggcggtggagcccagagcttggtgcacccggggctggtgcgcggggacacgccagagctggccgagcaccaccaccaccaccaccaccacgcgcatcctcacccgccgcacccgcaccacgcgcagggacccccgcaccacggcggcggcggcggcggcgcggggcctggactcaacagccacgacccgcactcggacgaggacacgccgacgtcggacgacctggagcagttcgccaagcagttcaagcagcggcgcatcaagctgggcttcacgcaggccgacgtggggttggcgctgggcacactctacggcaacgtgttctcgcagaccaccatctgccgcttcgaggccctgcagctgagcttcaagaacatgtgcaagctcaagccgctgctgaacaagtggctggaggaggcggactcaagcaccggcagccccacaagcatcgacaagatcgcggcgcagggccgcaagcgcaagaagcggacctctatcgaggtgagcgtcaagggcgcgctggagagccacttcctcaagtgccccaagccctccgcgcaggagatcaccaacctggccgacagcctgcagctcgagaaggaggtggtgcgggtctggttctgcaatcggcgccaaaaggagaagcgcatgacgccgcccgggatccaacagcagacgcccgacgacgtctactcgcaggtgggcaccgtgagcgccgacacgccgccgcctcaccacgggctgcagacgagcgttcagtgaagccagggcgcagagcgaagagggccgccgccgccgccgcctccgcagccgccgtcagcaccgccgccgcccctgccgccgccgccgccgccgccgccgccgctgccgccgccgcgccgaccctgcacctgggccgctccgggctccagcccaggcccatccgccgccctcccctccacccagagacaggcatgcccgcccttggaggagaaaacgcgggagaaacggaccaaggaggcatttttgcagtccaaggaaggaggggccaaaaaataaaaagcataataaacacccagactgttttgtatacatatataacaaacaaaaccggaagagaaaaagggggcgatcatgagatctcgttcatactgtggtggtgtttcgtttttgtttttgtttttaaagaagggtgaagatgcctgacgcacgaaaactgcactcgtgaggtttttccaccctgagatgacctacacggcagcggtggacagcacctgcctcgtcttctcctctttgaaaaaaagagagagagagagtcccctttcctttcactttctccctccaaaacagctgcctaaagagatccacggaaactttatttcctgggagcgacctgagagaaaacagaggcaccaggttccatcaggggacgacaccgtgctctgggaccctgtttttcttggccatattaaagtcatttggaaacaaatcaactctgaaatgggaaggaggggggaaaaacagtctccaagaaaaaaataattatattgacagcttctgaaactaacagactgaatagcaaagccaaaagaaaagtatcctcaaagtaaccttggaaataaaaggatcgggaaggagcagagggagagggggaacgtccgctgaggagtggcgagaggccccggccgagtcgggtcgcgggcgggcgggcgaactgggagcagagcgggggcccagccagcgaggccgccgagccaggcccggccgcgtacccaggctttgacggctgccattcagggtggacgatgcctaaagattccaccgctaatattttttttattaatattttttattttttatttctggactgactcagataaaggaatttagaaagactgagcaccagccgctgcacttctctggacttctctcctcaatccgttgccaactttgattgaatgggtgctgtggatgtgattatataatactgccatttccaagcagtgtttttggtaggttttaataaacagacttttcaaaagacggcaatatagaattgttagatccgttgttgatctaaaaatatttgctttatattttcattaaatgacttcttttaatattttattcagaatacttatgaactgctgcaaaacggtaatttatttttccccagatcttgtattacgtgtttttttcagacgagcacaaatcaaaatgaaatgaaaatatggacagttgttaggtaataagggtatcttttgatgtgatcatttgattgtaatttaatttgagtagtgattccgtaagagctgatcgagaaaataaatttgttagaatgaaa

SEQ ID NO: 42 - DNA, 2517 bp, Homo sapiens
atttccgcctctggcgaatggctcgtctgtagtgcacgccgcgggcccagctgcgaccccggccccgcccccgggaccccggccatggacgaactgttccccctcatcttcccggcagagccagcccaggcctctggcccctatgtggagatcattgagcagcccaagcagcggggcatgcgcttccgctacaagtgcgaggggcgctccgcgggcagcatcccaggcgagaggagcacagataccaccaagacccaccccaccatcaagatcaatggctacacaggaccagggacagtgcgcatctccctggtcaccaaggaccctcctcaccggcctcacccccacgagcttgtaggaaaggactgccgggatggcttctatgaggctgagctctgcccggaccgctgcatccacagtttccagaacctgggaatccagtgtgtgaagaagcgggacctggagcaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacaatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgtgcaccgacaagtggccattgtgttccggacccctccctacgcagaccccagcctgcaggctcctgtgcgtgtctccatgcagctgcggcggccttccgaccgggagctcagtgagcccatggaattccagtacctgccagatacagacgatcgtcaccggattgaggagaaacgtaaaaggacatatgagaccttcaagagcatcatgaagaagagtcctttcagcggacccaccgacccccggcctccacctcgacgcattgctgtgccttcccgcagctcagcttctgtccccaagccagcaccccagccctatccctttacgtcatccctgagcaccatcaactatgatgagtttcccaccatggtgtttccttctgggcagatcagccaggcctcggccttggccccggcccctccccaagtcctgccccaggctccagcccctgcccctgctccagccatggtatcagctctggcccaggccccagcccctgtcccagtcctagccccaggccctcctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagcagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagacttctcctccattgcggacatggacttctcagccctgctgagtcagatcagctcctaagggggtgacgcctgccctccccagagcactgggttgcaggggattgaagccctccaaaagcacttacggattctggtggggtgtgttccaactgcccccaactttgtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctgg

SEQ ID NO: 43 - DNA, 3433 bp, Homo sapiens
gttagcgcaggggatccgagctgggcaggacatgtgagatagtcacagttttccagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggcggatgttcccccccttcaaggtgcgagtcagcggcctggacaagaaggccaagtatatcctgctgatggacattgtagccgctgacgattgccgctataagttccacaactcgcgctggatggtggcgggcaaggccgaccctgagatgcccaaacgcatgtacatccacccagacagcccagccacgggggagcagtggatggctaagcctgtggccttccacaagctgaagctgaccaacaacatctctgacaagcacggcttcaccatcctaaactccatgcacaagtaccagccgcgcttccacatagtgcgagccaacgacatcctgaagctgccttacagcaccttccgcacctacgtgttcccggagaccgacttcatcgccgtcactgcctaccagaatgacaagatcacacagctgaagatcgacaacaacccgtttgccaagggcttccgggacaccgggaacggccggcgggagaaaaggaagcagctgacgctgccgtctctacgcttgtacgaggagcactgcaaacccgagcgcgatggcgcggagtcagacgcctcgtcgtgcgaccctccccccgcgcgggaaccacccacctccccgggcgcagcgcccagtccgctgcgcctgcaccgggcccgagctgaggagaagtcgtgcgccgcggacagcgacccggagcctgagcggttgagcgaggagcgtgcgggggcgccgctaggccgcagcccggctccagacagcgccagccccactcgcttgaccgaacccgagcgcgcccgggagcggcgtagtcccgagaggggcaaggagccggccgagagcggcggggacggcccgttcggcctgaggagcctggagaaggagcgcgccgaagctcggaggaaggacgaggggcgcaaggaggcggccgagggcaaggagcagggcctggcgccgctggtggtgcagacagacagtgcgtcccccctgggcgccggacacctgcccggcctggccttttccagccacttgcacgggcagcagttctttgggccgctgggagccggccagccgctcttcctgcaccctggacagttcaccatgggccctggcgccttctccgccatgggcatgggtcacctactggcctcggtggcaggcggcggcaacggcggaggtggcgggcctgggaccgccgcggggctggacgcaggcgggctgggtcccgcggccagcgcagcaagcaccgccgcgcccttcccgttccacctctcccagcacatgctggcatctcagggaattccaatgcccactttcggaggcctcttcccctacccctacacctacatggcagcagcagccgcagccgcctcggctttgcccgccactagtgctgcagctgccgccgccgcagccgccggctccctctcccggagccccttcctgggcagtgcccggccccgactgcgtttcagcccctatcagatcccggtcaccatcccgcctagcactagcctcctcaccaccgggctggcctctgagggctccaaggccgctggtggaaacagccgggagcctagccccctgcccgagctggctctccgcaaagtaggggccccatcccgcggtgccctgtcgcccagtggctcggccaaggaggcggccaatgaactgcagagcatccagagactggtgagtgggctggagagccagcgagccctctccccaggccgggagtcgcccaagtgaggggctgcccagctgctcccctgccacgcaggccacccgggctgcctgcccctgctgcttgggacgtgtacagcacagaatgagtatttatttaaataaaggagaaaagtgggctgcagcagccggaatagagcctcgtctggcaagtcggggcctgggacacttccctgggcctcaacaaggatcaggctgctggaaacacagtcacttgggagctgctgggctaggtccagatccgctccagcgtcaaggtggcatccgaaggtgtctctggtcttccagcgaggtgggagaggcctcatccagggcccagcggtccctgcagaagccagaaggtgcaggggccaggggtgggagcatcggagggagtcccagagccctggaccttgggcctagaccgcgtgataaaactgggttgagggatgctggaaccagttacgactgaagtcagtgtagacctgagctgggagggaacctgttagtctccccacctcttccctgaagagacaggcacccctcccagccgtggtcaacggagggagtggcacttctgccttgagtccccaggggaaaaaaaaaaaagatatttatgaaataaatggtaatttgtgtaaataagctttaaggttcccagaatatgcaaattggtattaatttattcaaaggtgtacattgctgtgtacatatatttagagattaactcatacatttaaagtttttttcattttacgtgagcatctatattgtacagggctgggggggcccttggctgcgggagaaggcccagagccctggaggagccaccaccccgccggcccctcgacccctcggcccctcggcccctccgcccgggtttggctcgcccggcccgcgggctccacctcaggttttcacttttcgctccggagcgagaacgaaacgacaaaaacgcaagaaaacaataaaacgctagaaagcgaa

SEQ ID NO: 44 - DNA, 2639 bp, Homo sapiens
actcggcccagggcagggaccccgccacggccgggaccgcccggcccggccccagcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaaacaa

SEQ ID NO: 45 - DNA, 3148 bp, Homo sapiens
gtctagagctgagtggagcccggctgcggatctgggaagcgcctcttcacggcactgggatccgcatctgcctgggatcatcaagccctagaagctgggtttctttaaattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaactgagacatttttcaatttctttcttgtcatccttgctggggactgaaaacgcttctgtgagacttgataatagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgataaacaagtgtttttcatatgaccctgttaacataatggcagtcatttccacaactgtttccaggtaaagttaacaatttgactagtaaaatcctgaagggcagtggaatgattggaaaagtaggggcgtgatttgactgcatgaagtaaaaggaaattgacacattgagttgttcagcaggtaagagaagagacagtggaggagtccagctcaattctaactactgtgtgacttggacaggttgcttcactcctggacggatgtaggggtttgaaagagatgatctcttacattcccctttggctttaaaattctaggagtccttgaaaatcttaattttttactgaactgagaggaagaaggagccttattctgtgtataattggaataagcagatctaggatcaaaagacggaagttggagaagctgatttccactttaagaaccctgtcaccctgggttgggatgtttctcctagtgtaggatgagtttctagctcctgggataattcgttttgtctaagcaaaagatgatttgaggtgggaccagatgagcaaggatgtccttgcagttgattctgcatgactataaaacaggccaaaattaaaaccacgaaggaatcctgaggcagattggcccctggcacctgaggagtgagcctgagggatcccactctgcagtaggagtaacgtgagcgagcaagtgaatggggtgggtttaccggctctgtaatctatcaacctagggcctcagcagtggccccctgcccagtaggaattggaccaatcccaagttctaaggcttgtcttaagtccttgcagaacaaggacaaactttctgaatcattcatttctctcatctagagctggtgggagattgagaggtgaatgggacatccaagatccctaaaaagaattgttcgatagcgtgcatgtgttataaagtggtgacacgggcatcctgttgaaatgatggatggctcactgccataggctgatagcagttgtcataaagatattttgggggaatttgaaaaggacgtaaagaaaaatctttcatattggcttgttggttatataacttcaaatttaataaaggaatacttacgtagtaattacatttccttgaaaaaactatagtgaatagaaatccctagccatttcattttttatgtttttaatgaagatctttaaaataccataggtggtaatcgtggaaaatttgaaaaatctcatgtcagtgtattaagatggtggagaagtttttttctccattatttaatggaactttgggtctttttattaaaaatgtgagactcatgaaattttggcagctgaatatttgtgaaataagaatgaattattaaaagatgtctttccata

SEQ ID NO: 46 - DNA, 1746 bp, Homo sapiens
gtatctcctccgtcccctcctgccgcgcggcgtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgccttgtc

SEQ ID NO: 47 - DNA, 2979 bp, Homo sapiens
attctcgctagttcgatcggtagcgggagcggagagcggaccccagagagccctgagcagccccaccgccgccgccggcctagttaccatcacaccccgggaggagccgcagctgccgcagccggccccagtcaccatcaccgcaaccatgagcagcgaggccgagacccagcagccgcccgccgccccccccgccgcccccgccctcagcgccgccgacaccaagcccggcactacgggcagcggcgcagggagcggtggcccgggcggcctcacatcggcggcgcctgccggcggggacaagaaggtcatcgcaacgaaggttttgggaacagtaaaatggttcaatgtaaggaacggatatggtttcatcaacaggaatgacaccaaggaagatgtatttgtacaccagactgccataaagaagaataaccccaggaagtaccttcgcagtgtaggagatggagagactgtggagtttgatgttgttgaaggagaaaagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggagggtgctgacaaccagggtgcaggagaacaaggtagaccagtgaggcagaatatgtatcggggatatagaccacgattccgcaggggccctcctcgccaaagacagcctagagaggacggcaatgaagaagataaagaaaatcaaggagatgagacccaaggtcagcagccacctcaacgtcggtaccgccgcaacttcaattaccgacgcagacgcccagaaaaccctaaaccacaagatggcaaagagacaaaagcagccgatccaccagctgagaattcgtccgctcccgaggctgagcagggcggggctgagtaaatgccggcttaccatctctaccatcatccggtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgtaaatttgtctagttttgctttagtttgtaagtatttagctatttataggacccttagcttgacccagtctacaaatagatgatgctcactggtaattccctcaggtaaaatgtctcaaaatctctaatcctttaagtggcatgcctgtgggcccatactaaaaattagaaaatacatactctgataacctggccatttttcattgaaggatttagctcatttgtaagaaagacttgagtgtagattttgggtgggtccctttggctgtgaggcattgtttaaaagggcattgctctagcctagaccgaccagactctcatcctgctccacttagttttgtcaccttgggagaatttgtttcagtgtgtcaattgaagatgccaattgaagtgttaggacaacctgtcacactgcctggtgtggtcatcaaatattggttcagctccttatgtcctagagatggaaacaagtaatataaaacccatgggaaagctgcttaggaacatggaggttggtgagcttgtaattatgtggttctcaacaccttaaatcctaagcctagtctggctgatcttttctctttttgagacggagtcttgttctgtcatcaggctggagtacagtggcacaatcttggctcactgcaacctccacctctaggtttaagcgattctcctgcctcggccaccttagtagctgggagtacaggtgcgtgccaccacacccagctaatttttgtatttttaatagagatggggttgcactgtgttagccaggatggtcttgatctcttgaccttgtgatccgcccgcctcagcctcccaaagtgctgggattacaggtgtgagccaccgcacctggcctctctggcttttgttttctaatgttttgttagatgttctttggcttgctttgtgaaatagtcatgtagttgatagtgactgctgccccgaaacactccagatcatcctggccagctatcagggcccaggggaagcagacagtaggggtcgggagtaggccagagtggcacatcaggaatcctgcagtgctgtggaagtcatctcctgcttgggactaactctttgcagaggacttgataagagactactcaaaaaaaatttttttaaccctacttagtgtaaatatctgtactgcagaagtgagttagcctatttcttgctggtgttcatgaaaatactgtgttggcaagagtgcagtggacctgaaacttcaactgttggtagcatctaaactgttacttacaactgcagacgcacacagtccctgacttaaacagtggtttgacttaggggcttttagtggggttacggtttctactgaatcaacattgttttcatggcatcacagagttgaaaaatcataaatgaaaccattgtaagttgactgcagtgttgccaacattaaatgcagtttcaacttaa

SEQ ID NO: 48 - DNA, 13740 bp, Homo sapiens
gtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgcagttttgatatatcattggattctgtctttgagttgtaggttatttcttagctgcatgttttaaactgaatttgcatagagttgtatgttaatgtttcagttaagagaaaaacttaagatacatgagtcattacataatgggtatgaaatctttataatcacccttccaccctctatggtgtcagtacacatcacgtgtcatagatacttaaaatgtaaatgttaacacttttccttcctgctgagatgtttagagcctagtgccagacccattcatttccttttgattatttttgagactcagtactgcatggacctcagaagcttttcaggtgcaaacttctagaagcttaggtgcatgcagtaatagcttcttgtgctgttaatgggttattatatattattctaagtgtaatgctgagaatctaaatgtgtctctgttgggatggttaacagatgaattggcaatttttattatgttcctggaagattacattattcatttgagtaccttctgttattaagcctaggtagccttactgtgcaactttttatttatccttggaaattttgaatgttgtgttcttacagagagcttttctgtagagatgactgctattcaatattttgtgttgcaacctcttaaaataatagctcttgttgacctttttgggatctgtttttctgatcttttgcagggtagttttatgattttttaggcatcaaataacctatgcaaagtattaatataatgaactcaagttgagtttttctcattataaagttaagacttctaagaaaatggtaacatttctttataactttcctgtgaaggtatagataaaacacatgaagtctgaagttgtatggaaaaaagggctttaactttgaaggaaaatatattgaaaagtgatttagccatcacaaaagagttcgtatttatgtgacagatgaaagtcatacctttaagcaaaacattgcaagtattataaagctgaatgctattttaactcacattggctgggtgcagtggctcacgcctgtaatcccagccctctggaaggctgagatgggaggattgcttgagtccaggagtttgagaccagcctggccaacatggcaaaaccccatctgtacaaaacatttaaaaattagccaggcgcgttagtgtgtgtctgtggtcccagctgctcaagaggctgaggaaggaggttcttcctccttccgaggctgcggtgagctatgttcactccagcctgggcaacagagcgagactctgtcaaaaaataaattaaaatatctgattatctggcttcaatgattttggctcctgtgcttgtggtaccatagtggtacaaaaattttcatagtttgaaaataaaacaggtattttgccagtaatgtatttctttctgccagcagccaagtcccaaaccactttcccctctgaacctctgcttacctaaatggtttcaaaattaatacatgctgctttgatttggcagcacacttaatatactgctgaaggaaaacttgtgttgaaagtctttaagataaaaatggtgtgataggccgggcgcagtggctcacgcctgtaatcccagcactttgggaggcccaggcgggtggatcatgaggtcaggagatggagaccatcctggctaacacggtgaaaccccgtttctactaaaaatacaaaaaattagctgggcgtagttgcggatgcctgtagtcccaactactctggagaccgaggcaggagaatggcgtgaacccgggaggcatagcttgcagtgagcggagatcacaccactgcactctagcctggacgacagattgagactccgtctcaaaaaaaaaaaatgctgtgattaaatttagaataattaagtaaggggtgctctcccaaattctcaggaatttcatgtatacggttattgacaaactgcaatagggttagtagacctgtttcagaaattatgtgaagctttatttgcattttatgcaaagaaggttgatactttgtagcaaggttttttgctctctgtataggtctgatgggcaaaaatggaacttttaaatatgggatagaattctaattaaaaattaattgaaagtgttaggcattggcagataaaacttaagctcatgagttcctgagtttgtagctataggctcagaggtggtgtacccatttaatatatttgaagtgtaatttttgcatgcatccaaacgtaattaagcttctagaaaataccttttttctaaatgcttctggggtccatagtgtggttgaattatgagtggagcaaattatattcatataattaactctgactcaaccttccttaagtagtagatgaagttgagtcaaagtggatgccaactgccctcacagaagacaacttttgggacttgataattcaggcaggcattgtgattgtcataattaaggaagctgtaaggttagtagggctggcaactttggctctaccttacatccaccccttttagaaaaacaagaaaacattttgtctggcactagtttctgttgtataagttttcatactgtttaacaagaccacagcaggtaaggattaatttttgagtggctgctggaattacttgatttgaatacttagtattttagtagtgtctcacacatttgccattaggtatgaataaaatattcctactgtactcctattccactaagttacattttgaacttagactcaccttaattaaacttaattaattggggagggggattccccaacaaaaagaagtacgggctcagagtggaattgtagtggacaatagttaaaaacaaagctgctccttttgcttgcttgatcattgggatttttaaaaaaaaaaattttaatgcatgtcttttaaattaattgggaactgtttttctaaaattaaaattttcttcttcctatagccctgccataggacaggctgaggctgagtctcagtgttgccctgttcagtctgaggcaagtgggatttattttattccttataggggctttcacagctttatggctgttggatatttatgtccccaaacttgcagcaagtttggtgaaggcccctaaatttaattaaacttaggatttttatactcttttggcagagaaggctctatattaatattcacgtttgactgtggtgttaataaacataagtatttcatatgcaattttatgtaatttgctgtgtgttacataattaacagcttcagtaaagcttgtgttcctatattgaacttcaataaattgacaaaatttgatatttttgattggaggcaagaaatgtttcattcaagttttttactttcacttctaggaaaatcttactggttttattttctccataaactattaaatttaacctcaaggataagtttaatcattggaaatgccactggatactgaaatgtgccttctcttttttgagacggagtttcactcttatcacccaggatggagtgcagtggtgcgatctcggttcactgcaacctctgcctcccggattcaagtgattctcctgcctcagcctcccgagtagctgggattataggctcccgccaccacatctggctattttttcaatatttttcagtagggatggggttttgccgtgttggccaggctggtctcaaactcctgacctcaggtgatccacccatctcagcctcccagagtgctggagtagcaggtgtgagccaccgcgcctggccaaaatctgcattctttttttttttttttttttttttttgagactgtctcgctgtgtcacccaggccagagtgcagtagcacgatctcagctcactacaacctccacctcctggattcaagcgattctcctgtctcagcctcccgagtagctgggactacaggtgcttgccaccacacccggctaattttttgtatttttagtagagacggggtttcaccgtgttagccaggatggtctcgatctcctgactttgcgatccccctgcctcggcctcccaaagtgctgggattacaggcgtgggccaccgcgcttggccaaaatctgcattcttaatcacaaacttacgcattgaatgttaaggctaaaaggtcatctggaaatgcttaattttaaaatattttcaagcctcaccacattagagcaaatgttaatgtagagccctgtaaaggtgggaaggtggtgtctatgtgtgtgcttgtgtatgtgggggtatagaccatatagttgatataacaacagaatttgggtgttacagacctttcagcatggatggattactaattttcaggtatcgaaactgaaatttgatacctgatcctgtggtaaagtatgttaaactatggttttggagtgattattttgaggttcattttcagcctcactgaacagtgttttacgcacatgtgaaaagtatccacatttgtttccaactaaaatttgcttttatttggtgagaaaagttgtgtgcgtgtgtttgttgtagggaataattagggaattggaagagaggccaaaaacaaacctgaattacttttgtttcttgtgtttgagccacgattctatccagatagcagtttactctgagcagtaacaatgaacaagcagtatagcatttagcaaacctggaattgtttgtatatggttttcattcttggaagcataaagaaaaaatatgcattaaatgaattgtaaattttgacttgttaaataacatgtttttcactataactaataggattttaatatttaaagaattttgttgcttccatgacaaaatatcccattggactattttataacctcagtaatcaacatttaagagtccttaattggagatctgttttctctattacctaccatcctgcaatatgctgaaatctttctaagttgcttatcttaattctaatggtgataattgaaaaaagtgtgctggaaatacaggctcttatctggttgagtactgggggtgggaaggatttagtaatgtcataatctgttgaaggtaatatctatagataactaagatagttcctttttttttgtagttctgtgactcagacaaataagattttgagaattatgtagtttttaggtgtctgtaacatccactagtaaaacttggcaaatgaaagaaaattgtgaagtcaccactttaactgagtcaaaattttgtttgaataagctgatgaaaatagacatgtaccctagaagtagatactctaaaattatacagacatgaatgtcttttttaaaaggttgtcattattgacctaatattgagtaatctttctgcgttattccaaattgaaatttgtttgctcttcattgtaacttttatgtaaaagtcctttaaaaggggattcaattataaggctatttgactatagggcagatttttataagtaaacattcccccaattccacttatgctaactgtctcatgacagtaaagtttactcctttttagaaaccctttctcagtattttaatttctgtcattgaatcatttaaataataaccttttgtttttatagcaaagaaatcatctgacttttctgtgtgatgtttcttggcaaaataagcacttgatgtatggtcatgtacataatggatattcattaattttgtgattagtgctgagttttctaaactactatcttaagctcttaggcaccctattatggatctaattcaaaccaatatgtaggaaatggagaaagtaggacttcagtttgcgcttcccaataactttaaatatatccaccttttccaagtgtttaagccctaaaacatctatctttatttttttacctggcatttttgttagaaaatagattacgttttaaagtaacattaaaaaaattcttcagtaagataattgcttttaataagtatatttttcttgctcttggctctatacatttttgcataatattttagtcttgaaaagcttttcattttcttaactctggaaaataatagtttggaactaaattagtttgagaaatctgaatcatctctctttaaatctgttcagttagtctcatgtattctcaggggaaaatgtctttattttactaagcggaagtagtagtcatattgaggcagaaatttgtagcccaaacaaggtaggtcttcgctgaaactaatttgaactattcctatttgaagcaaattgaacactattataaatctagactggctaattagatggaaactttgatggttaggttctttaagaggcatacaatccgttatgagaatgtttatgtttatgttttaatttttatcaaaataacctcagaggaggtacatgtgagtaaactgtcttaatggttgattacttggaacccacccattaattctaaatgatgtaatggtctataaggtagtaatctggcacagcttcagtaatgtgtgctgtgtttgtaaaaaggtgaagtactttattggcattttctaagccctctgacattgttagtgtctgggttggttggtttgcattttactattatggtggaatctgtgttccttcaccattggttaagtctgaggaactaacagtgaaattcattgatggccaacttggataaaaatgaagaatgatattttcccagtttactacacatggaccaatagtgattatttgggagagaacactgggtagtattgtttgacttaagaaccttaaatatattgaaaagtaatggcattcttgctcatgatttgcatttgttagtgaggtctcaccatagtattttaatgtagcttcttattaaaattttattcataaatagtttagcagtcacagaggtgaaaaaaaaaagatttgcaccatcatatccgagtctttactaataaaatgaggctgcttaagtacccaagtggagcaagggaagagttactacagttactgtaagtctgagttagaaaaaatacagagcatctagttattgagcaaagcccccttttacctgttcgcttattcaaagagaaacaatagaatttgcttctcagtacatgtttttaaaattgagaatctctgatgtgacaaaatcaatttttacaaaagttgaattaaaaacttttaaaaattgcttgtctttgggggtatgtctacatattcgtttaaatttagaaattcccacatgtttaagatatatgcccatcccctttttagagtaatcaaaatttctatcacagttcacatactggaatacatagtaaaattgagatgtgtccaagagattttcaatgttaattagctcattctaaatagccaatataaggtaacttctgtttaaaaaaaaaaaaaactagggaaaagttttaaatgtattagtatcaggctctgaggaaatttaatgcacattgactttttaaactatggattgaactcctcagtttaatacaatttgtgtttttgttaactagcagcagaatttcagcatttgctacttactggtagagaagaaaaatcccacagccctgccagtacaggttagtttaatctgtaagtacctgatgttcctatttttttcaaacatatccatataactcacacaaggaagaaagctgtgcggttacttaaatgttagtataactaataatagatccattggacactttaaacactcagtacttgggccaaagtagatctaggtttgctaaccccagttgtaataaaggtgtaatactgctcctttgttatctccttgtggttcaacctaagtagatacattgtacataaaaggaaaagacagtttcagttggctatgcccttgttgatagatgatatggagtccagggctttgggtccagggtcttttacttaagctatttcatggtggttctctcattcaccttttaactttttacattatgaatcaacctaagaaaaaaggcaagtttcctcacatctagaaatgataaatggtgtacagtcataagctagaatatgtttttataatgcttttttgttcttttagcaacacttgtaaatacaagtactcctctatttttgttctttttttgtaaactataacgtatcccgttggtgtaccagtgagttcattttactgtaaactaagaataacatacctttttaatactgaaagttgactactcatcaagaaatgtagctagattctttatgtaacacttttgaggggcagtggggacataatgggttgtggaaaatgtgttttaacatttttattttttttttattctacccgagttcattgttgtttgaaccatcctctaaagatttcctttaacctctaaatgttgtgcttttaggttgataacaaatgtaaagcactgaggagggaggaataaagcatacaagttaatttctaattttcgcaagcctgaaccatcctaatctgatagtaggatgtatggcttcttccttttcaccttgtgtgatgtttaatttgagacgatctagccataaaactagtaatcttgaattcctcttgagctggatggtgattagccattgtgaaaacagattatatggaaattgtgcatattgctaaattttaaaacatggatttatcaactgataataaaatatatcttacaagataaccacttgttttttaatgtaaaattgcacaagggcttaagtttcattgcctttcacagtttaatctgtatatgaaatggtgtagatacagtggaaatggttttccttaaaaccatctctttaaagctgcctttctggtgagtactgttttatacttttatatattataattttatcttctaaaattaactgaaataggacactttgattaaagaggtgagcactctgaatttctacatctttggatattacttgaatcaagaatattagaaaattattttaccacctggcatttcccttttaatttgctagttcacttttttctgaccttcacttaacagactataaatacaaaaactttgaacacataaattatttcattttggtgagatggaataaatgtttaaaattagtatttaagaaagttcttaaacattttttttagttggcagccaaaagatttttcttagtgctttggagacattgcataggtgtaaaattaagataccagaacttcattctgttcttgttgaagctgttgttgtggtgattcatgagcagtaagctggagttagagtggaagaagggtttaccaaaattcttcctgcagactagttgcttacagggtttctttgagaggcttaaaaatttcaaaagtattatttaagccactctaaccctgcatgaaaaattggagttagaaatactgatttctgagaccacgtataccagtgaaaattagcttctgagtaaatttctaatttatgccctgctttatttagcctcgctatatgtaacacatggattattttttccctctagtttttaactatatcctagattaaaaccagcatatgctaagaatgtttttacattctgtttcctcctgtgatctttctgaaccaataataaacagtcaactgtgatgctttttagtatgaacaatgatagttttctaaaatctgaaaatcaatacctgagtatgtgatgtggcaatgcattcttctagataagcactaaacaaagtatggaccctcaatttatgtctttaagatttaaagtgaagtaaatttctaaggaactgtgtcctttcctagcaggaataaacagtgaaaatttggtaagtatttaacttgaagtgcatgtaatagtgatgagagtaagtagccaaatttccgtaatataaggtaatgtttaaaagtgagcaataattattgcatctcttttgcgacttcatgtagatgtgattaacattttttacaaatttgcctgcataaagattaaattggaacataccttactcctttgtctggtttttttattttgtatggtgctttaaatactaattttatatttcaagctttttgcagggtagaaataagtggctgttaaagaaaatatcttcaagaaggattatttcagtgtccctttttaaaactcgatgatggctttcagtttatttaagtcttctgtttttcagctccagttaaaactgacaataggcagctatcaaaaatggaaaaaatcttgtgctctttctggaatattagaggaatcagttaataatagtaaagtggtattaacccaatacttgatttgcagtttttaaagcagtttttaaattgagagaaaaggggctgggcccagctgaggcgggtggatctcctgaggtcaggagtttgagaccagcctggccaacatagtgaaaccccgtctctactaaaaatacaaaaatcagccgggtgtggtgggacgtgcctgtaaccccagctactctggaggctgaggcaggaaaatcgcttgaacccagggggaggaggttgcagtgagccgagatggcgccgttgcactccagcttgggtgacagagcgagactccgtctcaaaaaaaaaaagaaaaaaagaaaaagtgataagatttgggagtctattccctgggatgttctattaataataaagtgataataaatgaaggttaaagtcaagtgttcaattactacaccaggaaagattgattatttctgaggaaaaggtccatttatttccaaactagtctgtagtggtttagagtaagcattattttatgaagtggtacaagattgcaaaggttagtaaagggacctgtctgtcaggtcaatcttcggtcttcacttttactggcaagggattatgtgaagagtaagtcatacaagggatatgattgtaaggaggtcctgaacaaagcatgataaatgttagtccatgtgtattattaaatggtctaaagaaaaatcatgactgatcgcataatttttaatgtaagtaaatgagctcactaagggtaattaaatactagcttttaaaatttaaagttctcacgaatattagtgcatcttgtcactttgatttgtcacctggttaaatagctggaagcttgtgcaaatgaaaaatgaaatggaagactacatttgtatatatatctgtataatttttgtttactagtaggttcagagagagatctgagatgttccttaacatgtagccatgtaattagaactcacaaggggcattgaaatgtttttctttttcagatagtctggggctatttacttattttaagtaagccaagtctaccatttgaaaaatggtgctttatttccatatctgaagcctgaagttattttttagtttgttttcatctaaaagtggaaagatttttgcttctgcgttattaagagcctctttgtttggaggagatggttatctccttcactcattaacctttgagtgcttgttatctacaaagatgaataaaatctttcatttattattta

SEQ ID NO: 49 - DNA, 1968 bp, Homo sapiens
ccctctcgctccccgggagcgcctggcggggccgctgggccgagggggccgccggcggggctggcgggcggggggcttcctgcgggcccggggggagccggcggccggcgcgggcgcggcgggccgggcaggggcgaggggcgccgggtcttgccccagaagctgcgggcacatccacgcctgaaatgcggcgctcagtcctggtcaggaacccaggccacaaaggcctgagacccgtttatgaagagctcgactctgactccgaggacctagaccccaatcctgaagatctggacccggtttctgaagacccagagcctgatcctgaagacctcaacactgtcccggaagacgtggaccccagctatgaagatctggagcccgtctcggaggatctggaccccgacgccgaagctccgggctcggaaccccaagatcccgaccccatgtcttcgagtttcgacctcgatccagatgtgattggccccgtacccctgattctcgatcctaacagcgacaccctcagccccggcgatccaaaagtggaccccatctcctctggcctcactgccaccccccaggtcttggccaccagccccgcggtgctccccgcccccgccagcccgccccggcccttctcctgcccggattgcgggcgagccttccgccgcagctccgggctgagccagcatcgccgcacgcacagcggcgagaagccgtaccgctgccccgactgcgggaagtccttcagccacggtgccaccctggctcagcaccgtggcatccacactggggcgcggccgtaccagtgcgcggcctgcggcaaggccttcggctggcgctccacgctgctgaaacatcgcagcagccacagcggggagaagccgcaccactgcccggtgtgtggcaaggccttcgggcacggctcgctcctggcacagcacctgcgcacgcacggcggcccgcggccccacaagtgcccggtgtgcgccaagggcttcggccagggctctgcgctgctcaaacacctgcgcacgcacacgggcgagcggccctacccgtgtccgcagtgcggcaaggccttcgggcagagctcggcgctgctgcagcaccagcgcacacacacggccgagcgcccctaccgctgcccccactgcggcaaagccttcgggcagagctccaacttgcaacaccacctgcgcatccacacgggcgagcggccctacgcctgcccgcactgctccaaggccttcggccagagctcagcgctgctccagcacctgcacgtgcattcgggcgagcgtccctatcgctgtcagctctgcgggaaggccttcggccaggcctccagcctcaccaagcacaaacgggtgcatgagggtgcagccgctgctgcagctgccgcggccgctgcagctgcagcagcggccgccggcctgggcctcgggcctggcctaagccctgcatccatgatgaggccggggcaggtctccctcctgggtcctgatgctgtttctgtgctcggctctggcttgggcctcagccctggcaccagctctggccgcaaccctgaccctggctctgggccgggcactctgccggatcccagctccaaacccctccccggctccagatccacccccagccctactcctgtggaatcttctgacccaaaggctgggcacgacgctggtcccgaccttgtgcccagcccagaccttgatcctgtgcccagcccagaccctgatcctgtgcccagccctgatcccaaccctgtgtcctgccctgacccctgttctcccactcgtggcactgtcagcccagccctccctaccggcgagagtccagagtgggtacaggagcaaggggcactgctggggcctgatggctgaaggagacgccggcatcctcgggggcctggggaagttgtgtgttgtgcagtcagtaaaatcctcccactgcctccgg

SEQ ID NO: 50 - DNA, 4797 bp, Homo sapiens
aagtgcgcatgtgcgcgaggagtcgctcgggcacttattgagcgccgactgtctacgggcggccgggggtgatgggcagaggcttcagtgtccccttcgcctccgcaggagaggagaggcagcagcatggcgagtgtcctgtcccgacgccttggaaagcggtccctcctgggagcccgggtgttgggacccagtgcctcggaggggccctcggctgccccaccctcggagccactgctagaaggggccgctccccagcctttcaccacctctgatgacaccccctgccaggagcagcccaaggaagtccttaaggctcccagcacctcgggccttcagcaggtggcctttcagcctgggcagaaggtttatgtgtggtacgggggtcaagagtgcacaggactggtggagcagcacagctggatggagggtcaggtgaccgtctggctgctggagcagaagctgcaggtctgctgcagggtggaggaggtgtggctggcagagctgcagggcccctgtccccaggcaccacccctggagcccggagcccaggccctggcctacaggcccgtctccaggaacatcgatgtcccaaagaggaagtcggacgcagtggaaatggatgagatgatggcggccatggtgctgacgtccctgtcctgcagccctgttgtacagagtcctcccgggaccgaggccaacttctctgcttcccgtgcggcctgcgacccatggaaggagagtggtgacatctcggacagcggcagcagcactaccagcggtcactggagtgggagcagtggtgtctccaccccctcgcccccccacccccaggccagccccaagtatttgggggatgcttttggttctccccaaactgatcatggctttgagaccgatcctgaccctttcctgctggacgaaccagctccacgaaaaagaaagaactctgtgaaggtgatgtacaagtgcctgtggccaaactgtggcaaagttctgcgctccattgtgggcatcaaacgacacgtcaaagccctccatctgggggacacagtggactctgatcagttcaagcgggaggaggatttctactacacagaggtgcagctgaaggaggaatctgctgctgctgctgctgctgctgccgcaggcaccccagtccctgggactcccacctccgagccagctcccacccccagcatgactggcctgcctctgtctgctcttccaccacctctgcacaaagcccagtcctccggcccagaacatcctggcccggagtcctccctgccctcaggggctctcagcaagtcagctcctgggtccttctggcacattcaggcagatcatgcataccaggctctgccatccttccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagtgccgcaaggtgtatggcatcgagcaccgggaccagtggtgcacggcctgccggtggaagaaggcctgccagcgctttctggactgagctgtgctgcaggttctactctgttcctggccctgccggcagccactgacaagaggccagtgtgtcaccagccctcagcagaaaccgaaagagaaagaacggaaacacggagtttgggctctgttggctaaggtgtaacacttaaagcaattttctcccattgtgcgaacattttattttttaaaaaaaagaaacaaaaatatttttccccctaaaataggagagagccaaaactgaccaaggctattcagcagtgaaccagtgaccaaagaattaattaccctccgtttcccacatccccactctctaggggattagcttgtgcgtgtcaaaagaaggaacagctcgttctgcttcctgctgagtcggtgaattctttgctttctaaactcttccagaaaggactgtgagcaagatgaatttacttttcttaaaaaaaaaaaaaaaaaaaaaaaaaaagagtttctggctgatgggtgactcagagtgcaggactgcctggccgtggggcagaggggtttgcccttctcggagggtacctcctgttccctgtctgagcatcctgcatggaagtcaaaggaaatccctttcttggtgacgacttaaatctgggttccctcagacattgggttgcaccccaacaaatattaaatggcttcttcttaaagcccagagaaagaggttttttaaaagactgtcgccaaatagctgagccaaaaggctgatcagaattcactttttggaatgtggcagttaaacactaccttgatcattctctcctctttcctcgaggaactcctggagggtttgagcgtctggaaactctctgctctgacccgaggaagcaccctcctgacgccgccttcctccggttattgaaaggacgcctcagaaatgctttgttttcttttacgatgtattcagaagcctttactgattaaagttttcttttatttgggtggccgggagagacccagggaggttctggaggttcctttctgtctcctggccccaccagggatttccccatttctgtttgctgcctgaaagcaggatgaggaaggccaaggagagtccttgcacccgtgagcgtcaggatgaggaaatgacaggaggaagacgtgggtttgggttagtggctgctggcgttttggcccttggtgtttctggagcctccagggatctaggggagcctgggctgcgtgcatgtcgataagcagagctgttcttggggagaaggagggaggtctcgggagtgtagcaccatgccaaccagccctgcgcgaagacagagtgagccacgcccggatggcagggcatgtttctgttttggtgtctcactttcctcccagcgtgacttatttggggattcctcagggcctactggaatgtgactgcccactgcccagctgcctcgggtacaagtcctggccctatgtcccagctgtcaggggctcagggaatcctacccagccacctgtcctgggatggagtgtcagcatccaccccttggttgtcatcgaggccgccctcccagtcctgggtgaagatatttgggccaccagggctcccttggccccttcacgtaggaaatagacacgtgctttttaatgcaggacactttgagtgttacaaaatctgtagacctggcagtagggtcatgatgttgggaagggtgtagtgccctaggttggtgacagaagggacagacacttgtgcacaggtgtctttggtgatggggtttttttttttataacttagtaaaaaaaaaaaaatgtatgtggaattctgtctcttggtaaagctcaaagccaggctagcctgaggtggcgcagggctctccttcctgtcccttcgatctccttgagaattaagagctggcagctgctgatggtgtttcccaacccccctcacttcccaagacaacccccagcttcaggtcctcatggggaggggagggcacgttcttgacacatgggaacttcgctcaggagggcctccccttcccctctccctcagagttttcactgccgtctcgtctttagaaagctgtttgaattccccccgcccccagtttggaccgtgtagatataactggatatacggatttttctctttgtgcaggcttcttatgccgttggtatacagggcaggaaagagaggaataaagggagagagcagtgtggaaaccacggtggttttgctttgttcttactaggttttggtgccaccttccctgcctgcgcttgtgccccctctcctccttggcactggcggcctccttgcctcccttccacccgtgctgccatcccgtgcctgtcgtgttggttcttcacacgtgctctgttctcggggttgttccattcatgccttcttggagggtgagggtggcttgggaaccgacccagtgatcatgcctactttcttctttgtatctccctccttcccagcccacccgggcagcagactctgatggaaggaaggtgccgtaggtgggcttttagaaactaacgggactggttttcaaagcagttatcttgggaaactgtttattccagcgatgtgacttttttcagaatatttcttggaatcatattcagagtctggggctgtgtgttgagcagccttaaggatgctagacactcatttagtgcccagggagtccagcgaatgacgtctgtggccaagcgaggtctcaggtgcaaagcaaaaggaccatttaaagtaaaatagcttggattcaatcatgtgacttttaaattggctcagaaagcaattttgtaatttcagagagtgttttgagccatggccacgttgtcattgtgagtctatagcttgactccttggagaacaatattcatttggttgtggagactgatttgctgggagaaatctgtcctgttactttctggtcatcccaggttctgacttttaccaggggcaaaaaaaaaaaaagcaagagggagataaatcccatctgtgagtttgtcttattggcgcctttttcctcagctgtcttccaagtattatttttactgttaaaaaattttttaaaaatgtgaaatgtaatgtttttacagcaacaatatgaaatatattttataaggaataaaatggtaccttgtctga

SEQ ID NO: 51 - protein, 271 aa, Homo sapiens
METNCRKLVSACVQLEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLMQPYDDMYPGYSYNNWAAKGLTSASLSTKSFPFFNSMNVNPLSSQSMFSPPNSISSMSMSSSMVPSAVTGVPGSSLNSLNNLNNLSSPSLNSAVPTPACPYAPPTPPYVYRDTCNSSLASLRLKAKQHSSFGYASVQNPASNLSACQYAVDRPV

SEQ ID NO: 52 - protein, 317 aa, Homo sapiens
METNCRKLVSACVQLGVQPAAVECLFSKDSEIKKVEFTDSPESRKEAASSKFFPRQHPGANEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLMQPYDDMYPGYSYNNWAAKGLTSASLSTKSFPFFNSMNVNPLSSQSMFSPPNSISSMSMSSSMVPSAVTGVPGSSLNSLNNLNNLSSPSLNSAVPTPACPYAPPTPPYVYRDTCNSSLASLRLKAKQHSSFGYASVQNPASNLSACQYAVDRPV

SEQ ID NO: 53 - protein, 324 aa, Homo sapiens
MNCMKGPLHLEHRAAGTKLSAVSSSSCHHPQPLAMASVLAPGQPRSLDSSKHRLEVHTISDTSSPEAAEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLMQPYDDMYPGYSYNNWAAKGLTSASLSTKSFPFFNSMNVNPLSSQSMFSPPNSISSMSMSSSMVPSAVTGVPGSSLNSLNNLNNLSSPSLNSAVPTPACPYAPPTPPYVYRDTCNSSLASLRLKAKQHSSFGYASVQNPASNLSACQYAVDRPV

SEQ ID NO: 54 - protein, 553 aa, Homo sapiens
MQARYSVSSPNSLGVVPYLGGEQSYYRAAAAAAGGGYTAMPAPMSVYSHPAHAEQYPGGMARAYGPYTPQPQPKDMVKPPYSYIALITMAIQNAPDKKITLNGIYQFIMDRFPFYRDNKQGWQNSIRHNLSLNECFVKVPRDDKKPGKGSYWTLDPDSYNMFENGSFLRRRRRFKKKDAVKDKEEKDRLHLKEPPPPGRQPPPAPPEQADGNAPGPQPPPVRIQDIKTENGTCPSPPQPLSPAAALGSGSAAAVPKIESPDSSSSSLSSGSSPPGSLPSARPLSLDGADSAPPPPAPSAPPPHHSQGFSVDNIMTSLRGSPQSAAAELSSGLLASAAASSRAGIAPPLALGAYSPGQSSLYSSPCSQTSSAGSSGGGGGGAGAAGGAGGAGTYHCNLQAMSLYAAGERGGHLQGAPGGAGGSAVDDPLPDYSLPPVTSSSSSSLSHGGGGGGGGGGQEAGHHPAAHQGRLTSWYLNQAGGDLGHLASAAAAAAAAGYPGQQQNFHSVREMFESQRIGLNNSPVNGNSSCQMAFPSSQSLYRTSGAFVYDCSKF

SEQ ID NO: 55 - protein, 460 aa, Homo sapiens
MHSPPRDQAAIMLWKLVENVKYEDIYEDRHDGVPSHSSRLSQLGSVSQGPYSSAPPLSHTPSSDFQPPYFPPPYQPLPYHQSQDPYSHVNDPYSLNPLHQPQQHPWGQRQRQEVGSEAGSLLPQPRAALPQLSGLDPRRDYHSVRRPDVLLHSAHHGLDAGMGDSLSLHGLGHPGMEDVQSVEDANNSGMNLLDQSVIKKVPVPPKSVTSLMMNKDGFLGGMSVNTGEVFCSVPGRLSLLSSTSKYKVTVGEVQRRLSPPECLNASLLGGVLRRAKSKNGGRSLRERLEKIGLNLPAGRRKAANVTLLTSLVEGEAVHLARDFGYICETEFPAKAVSEYLNRQHTDPSDLHSRKNMLLATKQLCKEFTDLLAQDRTPIGNSRPSPILEPGIQSCLTHFSLITHGFGAPAICAALTALQNYLTEALKGMDKMFLNNTTTNRHTSGEGPGSKTGDKEEKHRK

SEQ ID NO: 56 - protein, 406 aa, Homo sapiens
MDIATGPESLERCFPRGQTDCAKMLDGIKMEEHALRPGPATLGVLLGSDCPHPAVCEGCQRPISDRFLMRVNESSWHEECLQCAACQQALTTSCYFRDRKLYCKQDYQQLFAAKCSGCMEKIAPTEFVMRALECVYHLGCFCCCVCERQLRKGDEFVLKEGQLLCKGDYEKEKDLLSSVSPDESDSVKSEDEDGDMKPAKGQGSQSKGSGDDGKDPRRPKRPRTILTTQQRRAFKASFEVSSKPCRKVRETLAAETGLSVRVVQVWFQNQRAKMKKLARRHQQQQEQQNSQRLGQGEPGPGQGLGQEVLSSRMEGMMASYTPLAPPQQQIVAMEQSPYGSSDPFQQGLTPPQMPGNDSIFHDIDSDTSLTSLSDCFLGSSDVGSLQARVGNPIDRLYSMQSSYFAS

SEQ ID NO: 57 - protein, 395 aa, Homo sapiens
MDIATGPESLERCFPRGQTDCAKMLDGIKMEEHALRPGPATLGVLLGSDCPHPAVCEGCQRPISDRFLMRVNESSWHEECLQCAACQQALTTSCYFRDRKLYCKQDYQQLFAAKCSGCMEKIAPTEFVMRALECVYHLGCFCCCVCERQLRKGDEFVLKEGQLLCKGDYEKEKDLLSSVSPDESDSVKSEDEDGDMKPAKGQGSQSKGSGDDGKDPRRPKRPRTILTTQQRRAFKASFEVSSKPCRKVRETLAAETGLSVRVVQVWFQNQRAKMKKLARRHQQQQEQQNSQRLGQEVLSSRMEGMMASYTPLAPPQQQIVAMEQSPYGSSDPFQQGLTPPQMPGNDSIFHDIDSDTSLTSLSDCFLGSSDVGSLQARVGNPIDRLYSMQSSYFAS

SEQ ID NO: 58 - protein, 402 aa, Homo sapiens
MDIATGPESLERCFPRGQTDCAKMLDGIKMEEHALRPGPATLGVLLGSDCPHPAVCEGCQRPISDRFLMRVNESSWHEECLQCAACQQALTTSCYFRDRKLYCKQDYQQLFAAKCSGCMEKIAPTEFVMRALECVYHLGCFCCCVCERQLRKGDEFVLKEGQLLCKGDYEKEKDLLSSVSPDESDSVKSEDEDGDMKPAKGQGSQSKGSGDDGKDPRRPKRPRTILTTQQRRAFKASFEVSSKPCRKVRETLAAETGLSVRVVQVWFQNQRAKMKKLARRHQQQQEQQNSQRLGQEVLSSRMEGMMASYTPLAPPQQQIVAMEQSPYGSSDPFQQGLTPPQMPGDHMNPYGNDSIFHDIDSDTSLTSLSDCFLGSSDVGSLQARVGNPIDRLYSMQSSYFAS

SEQ ID NO: 59 - protein, 691 aa, Homo sapiens
MSALLQDPMIAGQVSKPLLSVRSEMNAELRGEDKAATSDSELNEPLLAPVESNDSEDTPSKLFGARGNPALSDPGTPDQHQASQTHPPFPVGPQPLLTAQQLASAVAGVMPGGPPALNQPILIPFNMAGQLGGQQGLVLTLPTANLTNIQGLVAAAAAGGIMTLPLQNLQATSSLNSQLQQLQLQLQQQQQQQQQQPPPSTNQHPQPAPQAPSQSQQQPLQPTPPQQPPPASQQPPAPTSQLQQAPQPQQHQPHSHSQNQNQPSPTQQSSSPPQKPSQSPGHGLPSPLTPPNPLQLVNNPLASQAAAAAAAMSSIASSQAFGNALSSLQGVTGQLVTNAQGQIIGTIPLMPNPGPSSQAASGTQGLQVQPITPQLLTNAQGQIIATVIGNQILPVINTQGITLSPIKPGQQLHQPSQTSVGQAASQGNLLHLAHSQASMSQSPVRQASSSSSSSSSSSALSVGQLVSNPQTAAGEVDGVNLEEIREFAKAFKIRRLSLGLTQTQVGQALSATEGPAYSQSAICRHTILRSHFFLPQEAQENTIASSLTAKLNPGLLYPARFEKLDITPKSAQKIKPVLERWMAEAEARHRAGMQNLTEFIGSEPSKKRKRRTSFTPQALEILNAHFEKNTHPSGQEMTEIAEKLNYDREVVRVWFCNKRQALKNTIKRLKQHEPATAVPLEPLTDSLEENS

SEQ ID NO: 60 - protein, 655 aa, Homo sapiens
MSALLQDPMIAGQVSKPLLSVRSEMNAELRGEDKAATSDSELNEPLLAPVESNDSEDTPSKLFGARGNPALSDPGTPDQHQASQTHPPFPVGPQPLLTAQQLASAVAGVMPGGPPALNQPILIPFNMAGQLGGQQGLVLTLPTANLTNIQGLVAAAAAGGIMTLPLQNLQATSSLNSQLQQLQLQLQQQQQQQQQQPPPSTNQHPQPAPQAPSQSQQQPLQPTPPQQPPPASQQPPAPTSQLQQAPQPQQHQPHSHSQNQNQPSPTQQSSSPPQKPSQSPGHGLPSPLTPPNPLQLVNNPLASQAAAAAAAMSSIASSQAFGNALSSLQGVTGQLVTNAQGQIIGTIPLMPNPGPSSQAASGTQGLQVQPITPQLLTNAQGQIIATVIGNQILPVINTQGITLSPIKPGQQLHQPSQTSVGQAASQGNLLHLAHSQASMSQSPVRQASSSSSSSSSSSALSVGQLVSNPQTAAGEVDGVNLEEIREFAKAFKIRRLSLGLTQTQVGQALSATEGPAYSQSAICRFEKLDITPKSAQKIKPVLERWMAEAEARHRAGMQNLTEFIGSEPSKKRKRRTSFTPQALEILNAHFEKNTHPSGQEMTEIAEKLNYDREVVRVWFCNKRQALKNTIKRLKQHEPATAVPLEPLTDSLEENS

SEQ ID NO: 61 - protein, 351 aa, Homo sapiens
MTEMSFLSSEVLVGDLMSPFDQSGLGAEESLGLLDDYLEVAKHFKPHGFSSDKAKAGSSEWLAVDGLVSPSNNSKEDAFSGTDWMLEKMDLKEFDLDALLGIDDLETMPDDLLTTLDDTCDLFAPLVQETNKQPPQTVNPIGHLPESLTKPDQVAPFTFLQPLPLSPGVLSSTPDHSFSLELGSEVDITEGDRKPDYTAYVAMIPQCIKEEDTPSDNDSGICMSPESYLGSPQHSPSTRGSPNRSLPSPGVLCGSARPKPYDPPGEKMVAAKVKGEKLDKKLKKMEQNKTAATRYRQKKRAEQEALTGECKELEKKNEALKERADSLAKEIQYLKDLIEEVRKARGKKRVP

SEQ ID NO: 62 - protein, 823 aa, Homo sapiens
MAASEAAAAAGSAALAAGARAVPAATTGAAAAASGPWVPPGPRLRGSRPRPAGATQQPAVPAPPAGELIQPSVSELSRAVRTNILCTVRGCGKILPNSPALNMHLVKSHRLQDGIVNPTIRKDLKTGPKFYCCPIEGCPRGPERPFSQFSLVKQHFMKMHAEKKHKCSKCSNSYGTEWDLKRHAEDCGKTFRCTCGCPYASRTALQSHIYRTGHEIPAEHRDPPSKKRKMENCAQNQKLSNKTIESLNNQPIPRPDTQELEASEIKLEPSFEDSCGSNTDKQTLTTPPRYPQKLLLPKPKVALVKLPVMQFSVMPVFVPTADSSAQPVVLGVDQGSATGAVHLMPLSVGTLILGLDSEACSLKESLPLFKIANPIAGEPISTGVQVNFGKSPSNPLQELGNTCQKNSISSINVQTDLSYASQNFIPSAQWATADSSVSSCSQTDLSFDSQVSLPISVHTQTFLPSSKVTSSIAAQTDAFMDTCFQSGGVSRETQTSGIESPTDDHVQMDQAGMCGDIFESVHSSYNVATGNIISNSLVAETVTHSLLPQNEPKTLNQDIEKSAPIINFSAQNSMLPSQNMTDNQTQTIDLLSDLENILSSNLPAQTLDHRSLLSDTNPGPDTQLPSGPAQNPGIDFDIEEFFSASNIQTQTEESELSTMTTEPVLESLDIETQTDFLLADTSAQSYGCRGNSNFLGLEMFDTQTQTDLNFFLDSSPHLPLGSILKHSSFSVSTDSSDTETQTEGVSTAKNIPALESKVQLNSTETQTMSSGFETLGSLFFTSNETQTAMDDFLLADLAWNTMESQFSSVETQTSAEPHTVSNF

SEQ ID NO: 63 - protein, 412 aa, Homo sapiens
MERIPSAQPPPACLPKAPGLEHGDLPGMYPAHMYQVYKSRRGIKRSEDSKETYKLPHRLIEKKRRDRINECIAQLKDLLPEHLKLTTLGHLEKAVVLELTLKHVKALTNLIDQQQQKIIALQSGLQAGELSGRNVETGQEMFCSGFQTCAREVLQYLAKHENTRDLKSSQLVTHLHRVVSELLQGGTSRKPSDPAPKVMDFKEKPSSPAKGSEGPGKNCVPVIQRTFAHSSGEQSGSDTDTDSGYGGESEKGDLRSEQPCFKSDHGRRFTMGERIGAIKQESEEPPTKKNRMQLSDDEGHFTSSDLISSPFLGPHPHQPPFCLPFYLIPPSATAYLPMLEKCWYPTSVPVLYPGLNASAAALSSFMNPDKISAPLLMPQRLPSPLPAHPSVDSSVLLQALKPIPPLNLETKD

SEQ ID NO: 64 - protein, 269 aa, Homo sapiens
MSAALFSLDGPARGAPWPAEPAPFYEPGRAGKPGRGAEPGALGEPGAAAPAMYDDESAIDFSAYIDSMAAVPTLELCHDELFADLFNSNHKAGGAGPLELLPGGPARPLGPGPAAPRLLKREPDWGDGDAPGSLLPAQVAACAQTVVSLAAAGQPTPPTSPEPPRSSPRQTPAPGPAREKSAGKRGPDRGSPEYRQRRERNNIAVRKSRDKAKRRNQEMQQKLVELSAENEKLHQRVEQLTRDLAGLRQFFKQLPSPPFLPAAGTADCR

SEQ ID NO: 65 - protein, 589 aa, Homo sapiens
MTGLLKRKFDQLDEDNSSVSSSSSSSGCQSRSCSPSSSVSRAWDSEEEGPWDQMPLPDRDFCGPRSFTPLSILKRARRERPGRVAFDGITVFYFPRCQGFTSVPSRGGCTLGMALRHSACRRFSLAEFAQEQARARHEKLRQRLKEEKLEMLQWKLSAAGVPQAEAGLPPVVDAIDDASVEEDLAVAVAGGRLEEVSFLQPYPARRRRALLRASGVRRIDREEKRELQALRQSREDCGCHCDRICDPETCSCSLAGIKCQMDHTAFPCGCCREGCENPMGRVEFNQARVQTHFIHTLTRLQLEQEAESFRELEAPAQGSPPSPGEEALVPTFPLAKPPMNNELGDNSCSSDMTDSSTASSSASGTSEAPDCPTHPGLPGPGFQPGVDDDSLARILSFSDSDFGGEEEEEEEGSVGNLDNLSCFHPADIFGTSDPGGLASWTHSYSGCSFTSGVLDENANLDASCFLNGGLEGSREGSLPGTSVPPSMDAGRSSSVDLSLSSCDSFELLQALPDYSLGPHYTSQKVSDSLDNIEAPHFPLPGLSPPGDASSCFLESLMGFSEPAAEALDPFIDSQFEDTVPASLMEPVPV

SEQ ID NO: 66 - protein, 205 aa, Homo sapiens
MPSKKKKYNARFPPARIKKIMQTDEEIGKVAAAVPVIISRALELFLESLLKKACQVTQSRNAKTMTTSHLKQCIELEQQFDFLKDLVASVPDMQGDGEDNHMDGDKGARRGRKPGSGGRKNGGMGTKSKDKKLSGTDSEQEDESEDTDTDGEEETSQPPPQASHPSAHFQSPPTPFLPFASTLPLPPAPPGPSAPDEEDEEDYDS

SEQ ID NO: 67 - protein, 543 aa, Homo sapiens
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 68 - protein, 581 aa, Homo sapiens
MTSAVVDSGGTILELSSNGVENQEESEKVSEYPAVIVEPVPSARLEQGYAAQVLVYDDETYMMQDVAEEQEVETENVETVEASVHSSNAHCTDKTIEAAEALLHMESPTCLRDSRSPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 69 - protein, 252 aa, Homo sapiens
MFQPAPKRCFTIESLVAKDSPLPASRSEDPIRPAALSYANSSPINPFLNGFHSAAAAAAGRGVYSNPDLVFAEAVSHPPNPAVPVHPVPPPHALAAHPLPSSHSPHPLFASQQRDPSTFYPWLIHRYRYLGHRFQGNDTSPESFLLHNALARKPKRIRTAFSPSQLLRLEHAFEKNHYVVGAERKQLAHSLSLTETQVKVWFQNRRTKFKRQKLEEEGSDSQQKKKGTHHINRWRIATKQASPEEIDVTSDD

SEQ ID NO: 70 - protein, 423 aa, Homo sapiens
MSSQVVGIEPLYIKAEPASPDSPKGSSETETEPPVALAPGPAPTRCLPGHKEEEDGEGAGPGEQGGGKLVLSSLPKRLCLVCGDVASGYHYGVASCEACKAFFKRTIQGSIEYSCPASNECEITKRRRKACQACRFTKCLRVGMLKEGVRLDRVRGGRQKYKRRPEVDPLPFPGPFPAGPLAVAGGPRKTAAPVNALVSHLLVVEPEKLYAMPDPAGPDGHLPAVATLCDLFDREIVVTISWAKSIPGFSSLSLSDQMSVLQSVWMEVLVLGVAQRSLPLQDELAFAEDLVLDEEGARAAGLGELGAALLQLVRRLQALRLEREEYVLLKALALANSDSVHIEDAEAVEQLREALHEALLEYEAGRAGPGGGAERRRAGRLLLTLPLLRQTAGKVLAHFYGVKLEGKVPMHKLFLEMLEAMMD

SEQ ID NO: 71 - protein, 469 aa, Homo sapiens
MNDFGIKNMDQVAPVANSYRGTLKRQPAFDTFDGSLFAVFPSLNEEQTLQEVPTGLDSISHDSANCELPLLTPCSKAVMSQALKATFSGFKKEQRRLGIPKNPWLWSEQQVCQWLLWATNEFSLVNVNLQRFGMNGQMLCNLGKERFLELAPDFVGDILWEHLEQMIKENQEKTEDQYEENSHLTSVPHWINSNTLGFGTEQAPYGMQTQNYPKGGLLDSMCPASTPSVLSSEQEFQMFPKSRLSSVSVTYCSVSQDFPGSNLNLLTNNSGTPKDHDSPENGADSFESSDSLLQSWNSQSSLLDVQRVPSFESFEDDCSQSLCLNKPTMSFKDYIQERSDPVEQGKPVIPAAVLAGFTGSGPIQLWQFLLELLSDKSCQSFISWTGDGWEFKLADPDEVARRWGKRKNKPKMNYEKLSRGLRYYYDKNIIHKTSGKRYVYRFVCDLQNLLGFTPEELHAILGVQPDTED

SEQ ID NO: 72 - protein, 380 aa, Homo sapiens
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQLSPEEEEKRRIRRERNKMAAAKCRNRRRELTDTLQAETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDDFLFPASSRPSGSETARSVPDMDLSGSFYAADWEPLHSGSLGMGPMATELEPLCTPVVTCTPSCTAYTSSFVFTYPEADSFPSCAAAHRKGSSSNEPSSDSLSSPTLLAL

SEQ ID NO: 73 - protein, 338 aa, Homo sapiens
MFQAFPGDYDSGSRCSSSPSAESQYLSSVDSFGSPPTAAASQECAGLGEMPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAL

SEQ ID NO: 74 - protein, 326 aa, Homo sapiens
MYQDYPGNFDTSSRGSSGSPAHAESYSSGGGGQQKFRVDMPGSGSAFIPTINAITTSQDLQWMVQPTVITSMSNPYPRSHPYSPLPGLASVPGHMALPRPGVIKTIGTTVGRRRRDEQLSPEEEEKRRIRRERNKLAAAKCRNRRRELTEKLQAETEELEEEKSGLQKEIAELQKEKEKLEFMLVAHGPVCKISPEERRSPPAPGLQPMRSGGGSVGAVVVKQEPLEEDSPSSSSAGLDKAQRSVIKPISIAGGFYGEEPLHTPIVVTSTPAVTPGTSNLVFTYPSVLEQESPASPSESCSKAHRRSSSSGDQSSDSLNSPTLLAL

SEQ ID NO: 75 - protein, 365 aa, Homo sapiens
MDPPAVVAESVSSLTIADAFIAAGESSAPTPPRPALPRRFICSFPDCSANYSKAWKLDAHLCKHTGERPFVCDYEGCGKAFIRDYHLSRHILTHTGEKPFVCAANGCDQKFNTKSNLKKHFERKHENQQKQYICSFEDCKKTFKKHQQLKIHQCQHTNEPLFKCTQEGCGKHFASPSKLKRHAKAHEGYVCQKGCSFVAKTWTELLKHVRETHKEEILCEVCRKTFKRKDYLKQHMKTHAPERDVCRCPREGCGRTYTTVFNLQSHILSFHEESRPFVCEHAGCGKTFAMKQSLTRHAVVHDPDKKKMKLKVKKSREKRSLASHLSGYIPPKRKQGQGLSLCQNGESPNCVEDKMLSTVAVLTLG

SEQ ID NO: 76 - protein, 826 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 77 - protein, 331 aa, Homo sapiens
MTAKMETTFYDDALNASFLPSESGPYGYSNPKILKQSMTLNLADPVGSLKPHLRAKNSDLLTSPDVGLLKLASPELERLIIQSSNGHITTTPTPTQFLCPKNVTDEQEGFAEGFVRALAELHSQNTLPSVTSAAQPVNGAGMVAPAVASVAGGSGSGGFSASLHSEPPVYANLSNFNPGALSSGGGAPSYGAAGLAFPAQPQQQQQPPHHLPQQMPVQHPRLQALKEEPQTVPEMPGETPPLSPIDMESQERIKAERKRMRNRIAASKCRKRKLERIARLEEKVKTLKAQNSELASTANMLREQVAQLKQKVMNHVNSGCQLMLTQQLQTF

SEQ ID NO: 78 - protein, 347 aa, Homo sapiens
MCTKMEQPFYHDDSYTATGYGRAPGGLSLHDYKLLKPSLAVNLADPYRSLKAPGARGPGPEGGGGGSYFSGQGSDTGASLKLASSELERLIVPNSNGVITTTPTPPGQYFYPRGGGSGGGAGGAGGGVTEEQEGFADGFVKALDDLHKMNHVTPPNVSLGATGGPPAGPGGVYAGPEPPPVYTNLSSYSPASASSGGAGAAVGTGSSYPTTTISYLPHAPPFAGGHPAQLGLGRGASTFKEEPQTVPEARSRDATPPVSPINMEDQERIKVERKRLRNRLAATKCRKRKLERIARLEDKVKTLKAENAGLSSTAGLLREQVAQLKQKVMTHVSNGCQLLLGVKGHAF

SEQ ID NO: 79 - protein, 304 aa, Homo sapiens
MMKKDALTLSLSEQVAAALKPAAAPPPTPLRADGAPSAAPPDGLLASPDLGLLKLASPELERLIIQSNGLVTTTPTSSQFLYPKVAASEEQEFAEGFVKALEDLHKQNQLGAGAAAAAAAAAAGGPSGTATGSAPPGELAPAAAAPEAPVYANLSSYAGGAGGAGGAATVAFAAEPVPFPPPPPPGALGPPRLAALKDEPQTVPDVPSFGESPPLSPIDMDTQERIKAERKRLRNRIAASKCRKRKLERISRLEEKVKTLKSQNTELASTASLLREQVAQLKQKVLSHVNSGCQLLPQHQVPAY

SEQ ID NO: 80 - protein, 480 aa, Homo sapiens
MLNFGASLQQTAEERMEMISERPKESMYSWNKTAEKSDFEAVEALMSMSCSWKSDFKKYVENRPVTPVSDLSEEENLLPGTPDFHTIPAFCLTPPYSPSDFEPSQVSNLMAPAPSTVHFKSLSDTAKPHIAAPFKEEEKSPVSAPKLPKAQATSVIRHTADAQLCNHQTCPMKAASILNYQNNSFRRRTHLNVEAARKNIPCAAVSPNRSKCERNTVADVDEKASAALYDFSVPSSETVICRSQPAPVSPQQKSVLVSPPAVSAGGVPPMPVICQMVPLPANNPVVTTVVPSTPPSQPPAVCPPVVFMGTQVPKGAVMFVVPQPVVQSSKPPVVSPNGTRLSPIAPAPGFSPSAAKVTPQIDSSRIRSHICSHPGCGKTYFKSSHLKAHTRTHTGEKPFSCSWKGCERRFARSDELSRHRRTHTGEKKFACPMCDRRFMRSDHLTKHARRHLSAKKLPNWQMEVSKLNDIALPPTPAPTQ

SEQ ID NO: 81 - protein, 244 aa, Homo sapiens
MSAAAYMDFVAAQCLVSISNRAAVPEHGVAPDAERLRLPEREVTKEHGDPGDTWKDYCTLVTIAKSLLDLNKYRPIQTPSVCSDSLESPDEDMGSDSDVTTESGSSPSHSPEERQDPGSAPSPLSLLHPGVAAKGKHASEKRHKCPYSGCGKVYGKSSHLKAHYRVHTGERPFPCTWPDCLKKFSRSDELTRHYRTHTGEKQFRCPLCEKRFMRSDHLTKHARRHTEFHPSMIKRSKKALANAL

SEQ ID NO: 82 - protein, 259 aa, Homo sapiens
MERKSPSGKKFRSKPQLARYLGGSMDLSTFDFRTGKMLMSKMNKSRQRVRYDSSNQVKGKPDLNTALPVRQTASIFKQPVTKITNHPSNKVKSDPQKAVDQPRQLFWEKKLSGLNAFDIAEELVKTMDLPKGLQGVGPGCTDETLLSAIASALHTSTMPITGQLSAAVEKNPGVWLNTTQPLCKAFMVTDEDIRKQEELVQQVRKRLEEALMADMLAHVEELARDGEAPLDKACAEDDDEEDEEEEEEEPDPDPEMEHV

SEQ ID NO: 83 - protein, 772 aa, Homo sapiens
MLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTEVNAWLVHRDPEGSVSGSQPNSGLALESSSGLQDVTGPDNGVRESETEQGFGEDLEDLGAVAPPVSGDLTKEDIDLIDILWRQDIDLGAGREVFDYSHRQKEQDVEKELRDGGEQDTWAGEGAEALARNLLVDGETGESFPAQVPSGEDQTALSLEECLRLLEATCPFGENAEFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 84 - protein, 152 aa, Homo sapiens
MANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 85 - protein, 614 aa, Homo sapiens
MTTLDSNNNTGGVITYIGSSGSSPSRTSPESLYSDNSNGSFQSLTQGCPTYFPPSPTGSLTQDPARSFGSIPPSLSDDGSPSSSSSSSSSSSSFYNGSPPGSLQVAMEDSSRVSPSKSTSNITKLNGMVLLCKVCGDVASGFHYGVHACEGCKGFFRRSIQQNIQYKRCLKNENCSIVRINRNRCQQCRFKKCLSVGMSRDAVRFGRIPKREKQRMLAEMQSAMNLANNQLSSQCPLETSPTQHPTPGPMGPSPPPAPVPSPLVGFSQFPQQLTPPRSPSPEPTVEDVISQVARAHREIFTYAHDKLGSSPGNFNANHASGSPPATTPHRWENQGCPPAPNDNNTLAAQRHNEALNGLRQAPSSYPPTWPPGPAHHSCHQSNSNGHRLCPTHVYAAPEGKAPANSPRQGNSKNVLLACPMNMYPHGRSGRTVQEIWEDFSMSFTPAVREVVEFAKHIPGFRDLSQHDQVTLLKAGTFEVLMVRFASLFNVKDQTVMFLSRTTYSLQELGAMGMGDLLSAMFDFSEKLNSLALTEEELGLFTAVVLVSADRSGMENSASVEQLQETLLRALRALVLKNRPLETSRFTKLLLKLPDLRTLNNMHSEKLLSFRVDAQ

SEQ ID NO: 86 - protein, 598 aa, Homo sapiens
MPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEVVRTDSLKGRRGRLPSKPKQPPDASPANLLTSLVRAHLDSGPSTAKLDYSKFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 87 - protein, 394 aa, Homo sapiens
MSGEDEQQEQTIAEDLVVTKYKMGGDIANRVLRSLVEASSSGVSVLSLCEKGDAMIMEETGKIFKKEKEMKKGIAFPTSISVNNCVCHFSPLKSDQDYILKEGDLVKIDLGVHVDGFIANVAHTFVVDVAQGTQVTGRKADVIKAAHLCAEAALRLVKPGNQNTQVTEAWNKVAHSFNCTPIEGMLSHQLKQHVIDGEKTIIQNPTDQQKKDHEKAEFEVHEVYAVDVLVSSGEGKAKDAGQRTTIYKRDPSKQYGLKMKTSRAFFSEVERRFDAMPFTLRAFEDEKKARMGVVECAKHELLQPFNVLYEKEGEFVAQFKFTVLLMPNGPMRITSGPFEPDLYKSEMEVQDAELKALLQSSASRKTQKKKKKKASKTAENATSGETLEENEAGD

SEQ ID NO: 88 - protein, 500 aa, Homo sapiens
MATAASNPYLPGNSLLAAGSIVHSDAAGAGGGGGGGGGGGGGGAGGGGGGMQPGSAAVTSGAYRGDPSSVKMVQSDFMQGAMAASNGGHMLSHAHQWVTALPHAAAAAAAAAAAAVEASSPWSGSAVGMAGSPQQPPQPPPPPPQGPDVKGGAGRDDLHAGTALHHRGPPHLGPPPPPPHQGHPGGWGAAAAAAAAAAAAAAAAHLPSMAGGQQPPPQSLLYSQPGGFTVNGMLSAPPGPGGGGGGAGGGAQSLVHPGLVRGDTPELAEHHHHHHHHAHPHPPHPHHAQGPPHHGGGGGGAGPGLNSHDPHSDEDTPTSDDLEQFAKQFKQRRIKLGFTQADVGLALGTLYGNVFSQTTICRFEALQLSFKNMCKLKPLLNKWLEEADSSTGSPTSIDKIAAQGRKRKKRTSIEVSVKGALESHFLKCPKPSAQEITNLADSLQLEKEVVRVWFCNRRQKEKRMTPPGIQQQTPDDVYSQVGTVSADTPPPHHGLQTSVQ

SEQ ID NO: 89 - protein, 551 aa, Homo sapiens
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 90 - protein, 712 aa, Homo sapiens
MREPALAASAMAYHPFHAPRPADFPMSAFLAAAQPSFFPALALPPGALAKPLPDPGLAGAAAAAAAAAAAAEAGLHVSALGPHPPAAHLRSLKSLEPEDEVEDDPKVTLEAKELWDQFHKLGTEMVITKSGRRMFPPFKVRVSGLDKKAKYILLMDIVAADDCRYKFHNSRWMVAGKADPEMPKRMYIHPDSPATGEQWMAKPVAFHKLKLTNNISDKHGFTILNSMHKYQPRFHIVRANDILKLPYSTFRTYVFPETDFIAVTAYQNDKITQLKIDNNPFAKGFRDTGNGRREKRKQLTLPSLRLYEEHCKPERDGAESDASSCDPPPAREPPTSPGAAPSPLRLHRARAEEKSCAADSDPEPERLSEERAGAPLGRSPAPDSASPTRLTEPERARERRSPERGKEPAESGGDGPFGLRSLEKERAEARRKDEGRKEAAEGKEQGLAPLVVQTDSASPLGAGHLPGLAFSSHLHGQQFFGPLGAGQPLFLHPGQFTMGPGAFSAMGMGHLLASVAGGGNGGGGGPGTAAGLDAGGLGPAASAASTAAPFPFHLSQHMLASQGIPMPTFGGLFPYPYTYMAAAAAAASALPATSAAAAAAAAAGSLSRSPFLGSARPRLRFSPYQIPVTIPPSTSLLTTGLASEGSKAAGGNSREPSPLPELALRKVGAPSRGALSPSGSAKEAANELQSIQRLVSGLESQRALSPGRESPK

SEQ ID NO: 91 - protein, 410 aa, Homo sapiens
MAKDAGLIEANGELKVFIDQNLSPGKGVVSLVAVHPSTVNPLGKQLLPKTFGQSNVNIAQQVVIGTPQRPAASNTLVVGSPHTPSTHFASQNQPSDSSPWSAGKRNRKGEKNGKGLRHFSMKVCEKVQRKGTTSYNEVADELVAEFSAADNHILPNESAYDQKNIRRRVYDALNVLMAMNIISKEKKEIKWIGLPTNSAQECQNLEVERQRRLERIKQKQSQLQELILQQIAFKNLVQRNRHAEQQASRPPPPNSVIHLPFIIVNTSKKTVIDCSISNDKFEYLFNFDNTFEIHDDIEVLKRMGMACGLESGSCSAEDLKMARSLVPKALEPYVTEMAQGTVGGVFITTAGSTSNGTRFSASDLTNGADGMLATSSNGSQYSGSRVETPVSYVGEDDEEDDDFNENDEDD

SEQ ID NO: 92 - protein, 144 aa, Homo sapiens
MKSQWCRPVAMDLGVYQLRHFSISFLSSLLGTENASVRLDNSSSGASVVAIDNKIEQAMDLVKSHLMYAVREEVEVLKEQIKELIEKNSQLEQENNLLKTLASPEQLAQFQAQLQTGSPPATTQPQGTTQPPAQPASQGSGPTA

SEQ ID NO: 93 - protein, 346 aa, Homo sapiens
MDMLDPGLDPAASATAAAAASHDKGPEAEEGVELQEGGDGPGAEEQTAVAITSVQQAAFGDHNIQYQFRTETNGGQVTYRVVQVTDGQLDGQGDTAGAVSVVSTAAFAGGQQAVTQVGVDGAAQRPGPAAASVPPGPAAPFPLAVIQNPFSNGGSPAAEAVSGEARFAYFPASSVGDTTAVSVQTTDQSLQAGGQFYVMMTPQDVLQTGTQRTIAPRTHPYSPKIDGTRTPRDERRRAQHNEVERRRRDKINNWIVQLSKIIPDCNADNSKTGASKGGILSKACDYIRELRQTNQRMQETFKEAERLQMDNELLRQQIEELKNENALLRAQLQQHNLEMVGEGTRQ

SEQ ID NO: 94 - protein, 324 aa, Homo sapiens
MSSEAETQQPPAAPPAAPALSAADTKPGTTGSGAGSGGPGGLTSAAPAGGDKKVIATKVLGTVKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 95 - protein, 494 aa, Homo sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDDSAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTATVPAPQPPVTKPLFPSAGQMGTPVTSSSTASSNSESLSASSKALFPSTAQAQAAVQGPVGTDFKPLNSTPATTTEPPKPTFPAYTQSTASTTSTTNSTAAKPAASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 96 - protein, 568 aa, Homo sapiens
MRRSVLVRNPGHKGLRPVYEELDSDSEDLDPNPEDLDPVSEDPEPDPEDLNTVPEDVDPSYEDLEPVSEDLDPDAEAPGSEPQDPDPMSSSFDLDPDVIGPVPLILDPNSDTLSPGDPKVDPISSGLTATPQVLATSPAVLPAPASPPRPFSCPDCGRAFRRSSGLSQHRRTHSGEKPYRCPDCGKSFSHGATLAQHRGIHTGARPYQCAACGKAFGWRSTLLKHRSSHSGEKPHHCPVCGKAFGHGSLLAQHLRTHGGPRPHKCPVCAKGFGQGSALLKHLRTHTGERPYPCPQCGKAFGQSSALLQHQRTHTAERPYRCPHCGKAFGQSSNLQHHLRIHTGERPYACPHCSKAFGQSSALLQHLHVHSGERPYRCQLCGKAFGQASSLTKHKRVHEGAAAAAAAAAAAAAAAAAGLGLGPGLSPASMMRPGQVSLLGPDAVSVLGSGLGLSPGTSSGRNPDPGSGPGTLPDPSSKPLPGSRSTPSPTPVESSDPKAGHDAGPDLVPSPDLDPVPSPDPDPVPSPDPNPVSCPDPCSPTRGTVSPALPTGESPEWVQEQGALLGPDG

SEQ ID NO: 97 - protein, 513 aa, Homo sapiens
MASVLSRRLGKRSLLGARVLGPSASEGPSAAPPSEPLLEGAAPQPFTTSDDTPCQEQPKEVLKAPSTSGLQQVAFQPGQKVYVWYGGQECTGLVEQHSWMEGQVTVWLLEQKLQVCCRVEEVWLAELQGPCPQAPPLEPGAQALAYRPVSRNIDVPKRKSDAVEMDEMMAAMVLTSLSCSPVVQSPPGTEANFSASRAACDPWKESGDISDSGSSTTSGHWSGSSGVSTPSPPHPQASPKYLGDAFGSPQTDHGFETDPDPFLLDEPAPRKRKNSVKVMYKCLWPNCGKVLRSIVGIKRHVKALHLGDTVDSDQFKREEDFYYTEVQLKEESAAAAAAAAAGTPVPGTPTSEPAPTPSMTGLPLSALPPPLHKAQSSGPEHPGPESSLPSGALSKSAPGSFWHIQADHAYQALPSFQIPVSPHIYTSVSWAAAPSAACSLSPVRSRSLSFSEPQQPAPAMKSHLIVTSPPRAQSGARKARGEAKKCRKVYGIEHRDQWCTACRWKKACQRFLD

SEQ ID NO: 98 - DNA, 3046 bp, Homo sapiens
agaagcgccggagcgccgcgtgaggagcccggccgtgagtgcgcgagtgtgccatggccgcggccaccaggcgcgtgttccatctgcagccgtgcgaaaactctcccaccatgtcgcagaatggatacttcgaggattcaagctactacaagtgtgacacagatgacaccttcgaagcccgagaggagatcctgggggatgaggccttcgacactgccaactcctccatcgtgtctggcgagagtatccgtttttttgtcaatgtcaaccttgagatgcaggccaccaacactgagaatgaagcgacttccggtggctgtgtgctcctgcacacctcccgaaagtacctgaagttaaagaacttcaaggaagagatccgtgcgcaccgcgacctagatggcttcctggcgcaggccagcatcgtcctgaacgagacggccacctccctggataacgtgctgcggaccatgcttcgccgcttcgccagggaccctgacaacaatgagcccaactgcaacctggacctgctcatggccatgctcttcaccgatgccggggcacccatgcggggtaaagtccacctgctgtcagataccatccaaggggtcaccgccacagtgacaggggtgcggtaccagcagtcgtggctctgcatcatctgtaccatgaaggccctacagaagcggcacgtgtgcatcagccgcctggttcgcccacagaactggggggagaattcctgtgaggttcggttcgtcatcctggtgctggccccacccaagatgaaaagcactaagactgcgatggaggtggcgcgcacgtttgccaccatgttctcggatatcgccttccgccagaagctcctggagacccgcacagaggaggaattcaaggaggccttggtgcatcagagacagctgctcaccatggtgagccacggtccagtggcgccgagaacgaaggaacgcagcacagtctccctccctgcccacagacacccagagcccccaaagtgcaaggactttgtcccttttgggaagggcatccgggaggacatcgcacgcaggttccccttgtaccccttggacttcactgatggcattattgggaaaaacaaggctgtgggcaaatacatcaccaccaccctgttcctctacttcgcctgcctcctgcccaccatcgctttcgggtctctcaatgacgagaacacagacggggccatcgacgtgcagaagaccatagccgggcagagcatcgggggcctgctctacgcgctcttctctgggcagccattggtgattctgctgaccaccgcgcccctggcgctctacatccaggtgattcgtgtcatctgtgatgactatgacctggacttcaactccttctacgcatggacgggcctgtggaatagtttcttccttgcgctttatgcctttttcaacctcagcctggtcatgagtctcttcaagaggtcgacggaggagatcatcgccctcttcatttccatcacgtttgtgctggatgccgtcaagggcacggttaaaatcttctggaagtactactatgggcattacttggacgactatcacacaaaaaggacttcatcccttgtcagcctgtcaggcctcggcgccagcctcaacgccagcctccacactgccctcaacgccagcttcctcgccagccccacggagctgccctcggccacacactcaggccaggcgaccgccgtgctcagcctcctcatcatgctgggcacgctctggctgggctacaccctctaccaattcaagaagagcccctacctgcacccctgcgtgcgagagatcctgtccgactgcgccctgcccatcgcggtgctcgccttctccctcatcagctcccatggcttccgggaaatcgagatgagcaagttccgctacaaccccagcgagagcccctttgcgatggcgcagatccagtcgctgtccctgagggccgtcagcggtgccatgggcctcggcttcctgctgtccatgctcttcttcatcgagcagaacttggtggccgccttggtgaatgcaccggagaacaggctggtgaagggcactgcctaccactgggacctcctgctcctcgccatcatcaacacagggctgtctctgtttgggctgccttggatccatgccgcctacccccactccccgctgcacgtgcgagccctggccttagtggaggagcgtgtggagaacggacacatctatgacacgattgtgaacgtgaaggagacgcggctgacctcgctgggcgccagcgtcctggtgggcctgtccctgttgctgctgccggtcccgcttcagtggatccccaagcccgtgctctatggcctcttcctctacatcgcgctcacctccctcgatggcaaccagctcgtccagcgcgtggccctgctgctcaaggagcagactgcgtaccccccgacacactacatccggagggtgccccagaggaagatccactacttcacgggcctgcaggtgcttcagctgctgctgctgtgtgccttcggcatgagctccctgccctacatgaagatgatctttcccctcatcatgatcgccatgatccccatccgctatatcctgctgccccgaatcattgaagccaagtacttggatgtcatggacgctgagcacaggccttgactggcagaccctgcccacgccccattcgccagccctccacgtcctcccaggctggctctggagctgtgaggggaggtgtaggtgtgtgggtgactgctctgtgctgcgccttctcatggctgactcaggcctggggcatctgggcattgtaggggtgcagtggtatgtgcccacccctctcccattatcctttagctttaggccaagagcgttgctcagggcagcttctgcccagggtgggtgggactgagcaggatggattttcttttgataaaagagtcgatgcctgaaagagaaaccatttccttgattgtgtaaggaacttgctggacgcacattagagaataaagctcctgtttctaggc

SEQ ID NO: 99 - DNA, 3089 bp, Homo sapiens
ctttctccctagggtggcgtgggttgcatccctcggaagagcgaaggaatgagccaggtcggggggcggggagacaggtgcacacaggaggtccagggcttggtccatggggctggtgacctttctgcttcccttgcagaaaactctcccaccatgtcgcagaatggatacttcgaggattcaagctactacaagtgtgacacagatgacaccttcgaagcccgagaggagatcctgggggatgaggccttcgacactgccaactcctccatcgtgtctggcgagagtatccgtttttttgtcaatgtcaaccttgagatgcaggccaccaacactgagaatgaagcgacttccggtggctgtgtgctcctgcacacctcccgaaagtacctgaagttaaagaacttcaaggaagagatccgtgcgcaccgcgacctagatggcttcctggcgcaggccagcatcgtcctgaacgagacggccacctccctggataacgtgctgcggaccatgcttcgccgcttcgccagggaccctgacaacaatgagcccaactgcaacctggacctgctcatggccatgctcttcaccgatgccggggcacccatgcggggtaaagtccacctgctgtcagataccatccaaggggtcaccgccacagtgacaggggtgcggtaccagcagtcgtggctctgcatcatctgtaccatgaaggccctacagaagcggcacgtgtgcatcagccgcctggttcgcccacagaactggggggagaattcctgtgaggttcggttcgtcatcctggtgctggccccacccaagatgaaaagcactaagactgcgatggaggtggcgcgcacgtttgccaccatgttctcggatatcgccttccgccagaagctcctggagacccgcacagaggaggaattcaaggaggccttggtgcatcagagacagctgctcaccatggtgagccacggtccagtggcgccgagaacgaaggaacgcagcacagtctccctccctgcccacagacacccagagcccccaaagtgcaaggactttgtcccttttgggaagggcatccgggaggacatcgcacgcaggttccccttgtaccccttggacttcactgatggcattattgggaaaaacaaggctgtgggcaaatacatcaccaccaccctgttcctctacttcgcctgcctcctgcccaccatcgctttcgggtctctcaatgacgagaacacagacggggccatcgacgtgcagaagaccatagccgggcagagcatcgggggcctgctctacgcgctcttctctgggcagccattggtgattctgctgaccaccgcgcccctggcgctctacatccaggtgattcgtgtcatctgtgatgactatgacctggacttcaactccttctacgcatggacgggcctgtggaatagtttcttccttgcgctttatgcctttttcaacctcagcctggtcatgagtctcttcaagaggtcgacggaggagatcatcgccctcttcatttccatcacgtttgtgctggatgccgtcaagggcacggttaaaatcttctggaagtactactatgggcattacttggacgactatcacacaaaaaggacttcatcccttgtcagcctgtcaggcctcggcgccagcctcaacgccagcctccacactgccctcaacgccagcttcctcgccagccccacggagctgccctcggccacacactcaggccaggcgaccgccgtgctcagcctcctcatcatgctgggcacgctctggctgggctacaccctctaccaattcaagaagagcccctacctgcacccctgcgtgcgagagatcctgtccgactgcgccctgcccatcgcggtgctcgccttctccctcatcagctcccatggcttccgggaaatcgagatgagcaagttccgctacaaccccagcgagagcccctttgcgatggcgcagatccagtcgctgtccctgagggccgtcagcggtgccatgggcctcggcttcctgctgtccatgctcttcttcatcgagcagaacttggtggccgccttggtgaatgcaccggagaacaggctggtgaagggcactgcctaccactgggacctcctgctcctcgccatcatcaacacagggctgtctctgtttgggctgccttggatccatgccgcctacccccactccccgctgcacgtgcgagccctggccttagtggaggagcgtgtggagaacggacacatctatgacacgattgtgaacgtgaaggagacgcggctgacctcgctgggcgccagcgtcctggtgggcctgtccctgttgctgctgccggtcccgcttcagtggatccccaagcccgtgctctatggcctcttcctctacatcgcgctcacctccctcgatggcaaccagctcgtccagcgcgtggccctgctgctcaaggagcagactgcgtaccccccgacacactacatccggagggtgccccagaggaagatccactacttcacgggcctgcaggtgcttcagctgctgctgctgtgtgccttcggcatgagctccctgccctacatgaagatgatctttcccctcatcatgatcgccatgatccccatccgctatatcctgctgccccgaatcattgaagccaagtacttggatgtcatggacgctgagcacaggccttgactggcagaccctgcccacgccccattcgccagccctccacgtcctcccaggctggctctggagctgtgaggggaggtgtaggtgtgtgggtgactgctctgtgctgcgccttctcatggctgactcaggcctggggcatctgggcattgtaggggtgcagtggtatgtgcccacccctctcccattatcctttagctttaggccaagagcgttgctcagggcagcttctgcccagggtgggtgggactgagcaggatggattttcttttgataaaagagtcgatgcctgaaagagaaaccatttccttgattgtgtaaggaacttgctggacgcacattagagaataaagctcctgtttctaggc

SEQ ID NO: 100 - DNA, 3245 bp, Homo sapiens
cttttggaccaacggctctggcttccaggcggccgggacgcggtcccaggactggagaccgttgcctgtcggcccccgtgtgacccggggcgcgtgacgggggtcgggggaactgcgcctgcaatgggcgtttatggcccccaggaccggtctgagagtgagaagagggatgtgcagagagatcccccgccttggcatccgaggagagagggggagaggcccgctcgggcccggtcccttcctctcgctgcagcggggcagggttttctcaggaaaacctggattagcgaacatgaaaactctcccaccatgtcgcagaatggatacttcgaggattcaagctactacaagtgtgacacagatgacaccttcgaagcccgagaggagatcctgggggatgaggccttcgacactgccaactcctccatcgtgtctggcgagagtatccgtttttttgtcaatgtcaaccttgagatgcaggccaccaacactgagaatgaagcgacttccggtggctgtgtgctcctgcacacctcccgaaagtacctgaagttaaagaacttcaaggaagagatccgtgcgcaccgcgacctagatggcttcctggcgcaggccagcatcgtcctgaacgagacggccacctccctggataacgtgctgcggaccatgcttcgccgcttcgccagggaccctgacaacaatgagcccaactgcaacctggacctgctcatggccatgctcttcaccgatgccggggcacccatgcggggtaaagtccacctgctgtcagataccatccaaggggtcaccgccacagtgacaggggtgcggtaccagcagtcgtggctctgcatcatctgtaccatgaaggccctacagaagcggcacgtgtgcatcagccgcctggttcgcccacagaactggggggagaattcctgtgaggttcggttcgtcatcctggtgctggccccacccaagatgaaaagcactaagactgcgatggaggtggcgcgcacgtttgccaccatgttctcggatatcgccttccgccagaagctcctggagacccgcacagaggaggaattcaaggaggccttggtgcatcagagacagctgctcaccatggtgagccacggtccagtggcgccgagaacgaaggaacgcagcacagtctccctccctgcccacagacacccagagcccccaaagtgcaaggactttgtcccttttgggaagggcatccgggaggacatcgcacgcaggttccccttgtaccccttggacttcactgatggcattattgggaaaaacaaggctgtgggcaaatacatcaccaccaccctgttcctctacttcgcctgcctcctgcccaccatcgctttcgggtctctcaatgacgagaacacagacggggccatcgacgtgcagaagaccatagccgggcagagcatcgggggcctgctctacgcgctcttctctgggcagccattggtgattctgctgaccaccgcgcccctggcgctctacatccaggtgattcgtgtcatctgtgatgactatgacctggacttcaactccttctacgcatggacgggcctgtggaatagtttcttccttgcgctttatgcctttttcaacctcagcctggtcatgagtctcttcaagaggtcgacggaggagatcatcgccctcttcatttccatcacgtttgtgctggatgccgtcaagggcacggttaaaatcttctggaagtactactatgggcattacttggacgactatcacacaaaaaggacttcatcccttgtcagcctgtcaggcctcggcgccagcctcaacgccagcctccacactgccctcaacgccagcttcctcgccagccccacggagctgccctcggccacacactcaggccaggcgaccgccgtgctcagcctcctcatcatgctgggcacgctctggctgggctacaccctctaccaattcaagaagagcccctacctgcacccctgcgtgcgagagatcctgtccgactgcgccctgcccatcgcggtgctcgccttctccctcatcagctcccatggcttccgggaaatcgagatgagcaagttccgctacaaccccagcgagagcccctttgcgatggcgcagatccagtcgctgtccctgagggccgtcagcggtgccatgggcctcggcttcctgctgtccatgctcttcttcatcgagcagaacttggtggccgccttggtgaatgcaccggagaacaggctggtgaagggcactgcctaccactgggacctcctgctcctcgccatcatcaacacagggctgtctctgtttgggctgccttggatccatgccgcctacccccactccccgctgcacgtgcgagccctggccttagtggaggagcgtgtggagaacggacacatctatgacacgattgtgaacgtgaaggagacgcggctgacctcgctgggcgccagcgtcctggtgggcctgtccctgttgctgctgccggtcccgcttcagtggatccccaagcccgtgctctatggcctcttcctctacatcgcgctcacctccctcgatggcaaccagctcgtccagcgcgtggccctgctgctcaaggagcagactgcgtaccccccgacacactacatccggagggtgccccagaggaagatccactacttcacgggcctgcaggtgcttcagctgctgctgctgtgtgccttcggcatgagctccctgccctacatgaagatgatctttcccctcatcatgatcgccatgatccccatccgctatatcctgctgccccgaatcattgaagccaagtacttggatgtcatggacgctgagcacaggccttgactggcagaccctgcccacgccccattcgccagccctccacgtcctcccaggctggctctggagctgtgaggggaggtgtaggtgtgtgggtgactgctctgtgctgcgccttctcatggctgactcaggcctggggcatctgggcattgtaggggtgcagtggtatgtgcccacccctctcccattatcctttagctttaggccaagagcgttgctcagggcagcttctgcccagggtgggtgggactgagcaggatggattttcttttgataaaagagtcgatgcctgaaagagaaaccatttccttgattgtgtaaggaacttgctggacgcacattagagaataaagctcctgtttctaggc

SEQ ID NO: 101 - DNA, 2932 bp, Homo sapiens
agaagcgccggagcgccgcgtgaggagcccggccgtgagtgcgcgagtgtgccatggccgcggccaccaggcgcgtgttccatctgcagccgtgcgaaaactctcccaccatgtcgcagaatggatacttcgaggattcaagctactacaagtgtgacacagatgacaccttcgaagcccgagaggagatcctgggggatgaggccttcgacactgccaactcctccatcgtgtctggcgagagtatccgtttttttgtcaatgtcaaccttgagatgcaggccaccaacactgagaatgaagcgacttccggtggctgtgtgctcctgcacacctcccgaaagtacctgaagttaaagaacttcaaggaagagatccgtgcgcaccgcgacctagatggcttcctggcgcaggccagcatcgtcctgaacgagacggccacctccctggataacgtgctgcggaccatgcttcgccgcttcgccagggaccctgacaacaatgagcccaactgcaacctggacctgctcatggccatgctcttcaccgatgccggggcacccatgcggggtaaagtccacctgctgtcagataccatccaaggggtcaccgccacagtgacaggggtgcggtaccagcagtcgtggctctgcatcatctgtaccatgaaggccctacagaagcggcacgtgtgcatcagccgcctggttcgcccacagaactggggggagaattcctgtgaggttcggttcgtcatcctggtgctggccccacccaagatgaaaagcactaagactgcgatggaggtggcgcgcacgtttgccaccatgttctcggatatcgccttccgccagaagctcctggagacccgcacagaggaggaattcaaggaggccttggtgcatcagagacagctgctcaccatggtgagccacggtccagtggcgccgagaacgaaggaacgcagcacagtctccctccctgcccacagacacccagagcccccaaagtgcaaggactttgtcccttttgggaagggcatccgggaggacatcgcacgcaggttccccttgtaccccttggacttcactgatggcattattgggaaaaacaaggctgtgggcaaatacatcaccaccaccctgttcctctacttcgcctgcctcctgcccaccatcgctttcgggtctctcaatgacgagaacacagacggggccatcgtgattcgtgtcatctgtgatgactatgacctggacttcaactccttctacgcatggacgggcctgtggaatagtttcttccttgcgctttatgcctttttcaacctcagcctggtcatgagtctcttcaagaggtcgacggaggagatcatcgccctcttcatttccatcacgtttgtgctggatgccgtcaagggcacggttaaaatcttctggaagtactactatgggcattacttggacgactatcacacaaaaaggacttcatcccttgtcagcctgtcaggcctcggcgccagcctcaacgccagcctccacactgccctcaacgccagcttcctcgccagccccacggagctgccctcggccacacactcaggccaggcgaccgccgtgctcagcctcctcatcatgctgggcacgctctggctgggctacaccctctaccaattcaagaagagcccctacctgcacccctgcgtgcgagagatcctgtccgactgcgccctgcccatcgcggtgctcgccttctccctcatcagctcccatggcttccgggaaatcgagatgagcaagttccgctacaaccccagcgagagcccctttgcgatggcgcagatccagtcgctgtccctgagggccgtcagcggtgccatgggcctcggcttcctgctgtccatgctcttcttcatcgagcagaacttggtggccgccttggtgaatgcaccggagaacaggctggtgaagggcactgcctaccactgggacctcctgctcctcgccatcatcaacacagggctgtctctgtttgggctgccttggatccatgccgcctacccccactccccgctgcacgtgcgagccctggccttagtggaggagcgtgtggagaacggacacatctatgacacgattgtgaacgtgaaggagacgcggctgacctcgctgggcgccagcgtcctggtgggcctgtccctgttgctgctgccggtcccgcttcagtggatccccaagcccgtgctctatggcctcttcctctacatcgcgctcacctccctcgatggcaaccagctcgtccagcgcgtggccctgctgctcaaggagcagactgcgtaccccccgacacactacatccggagggtgccccagaggaagatccactacttcacgggcctgcaggtgcttcagctgctgctgctgtgtgccttcggcatgagctccctgccctacatgaagatgatctttcccctcatcatgatcgccatgatccccatccgctatatcctgctgccccgaatcattgaagccaagtacttggatgtcatggacgctgagcacaggccttgactggcagaccctgcccacgccccattcgccagccctccacgtcctcccaggctggctctggagctgtgaggggaggtgtaggtgtgtgggtgactgctctgtgctgcgccttctcatggctgactcaggcctggggcatctgggcattgtaggggtgcagtggtatgtgcccacccctctcccattatcctttagctttaggccaagagcgttgctcagggcagcttctgcccagggtgggtgggactgagcaggatggattttcttttgataaaagagtcgatgcctgaaagagaaaccatttccttgattgtgtaaggaacttgctggacgcacattagagaataaagctcctgtttctaggc

SEQ ID NO: 102 - DNA, 5577 bp, Homo sapiens
ggatcacagcccttccccgatcctctccgtgggagccagcgagcctctctccctgatcttacgtgctcaagggagctcacacgttcaccaactcacccttgaagtcatctcaagaacaaaagacaactgaaagaagctgttgtgaaggcagagcagcatctgctgaagagacagaaaccagccccagaggtgtcacaggaaggcaccagcaaggacattggtctttgatttgattcagcagtcctgtcaagtataaatgtgatggctgtgctgcctggccctctgcagctgctgggagtgctgcttaccatttccctgagttccatcaggctcattcaggctggtgcctactatgggatcaagccgctgccacctcaaattcctcctcagatgccaccacaaattccacaataccagcccctgggtcagcaagtacctcacatgcctttggccaaagatggccttgccatgggcaaggagatgccccacttgcagtatggcaaagagtatccacacctaccccaatatatgaaggaaattcaaccggcgccaagaatgggcaaggaagccgtacccaagaaaggcaaagaaataccattagccagtttacgaggggaacaaggtccccgtggagagcctggcccaagaggaccacctgggccccctggtttgccaggtcatgggatacctggaattaaaggaaaaccagggccacagggatatccaggagttggaaagccaggtatgcctggaatgccagggaagccaggagccatgggcatgcctggggcaaaaggagaaattggacagaaaggggaaattgggcctatggggatcccaggaccacaaggacctccagggcctcatggacttcctggcattgggaagccaggtgggccagggttaccagggcaaccaggaccaaagggtgatcgaggacccaaaggactaccaggacctcaaggccttcggggtcctaaaggagacaagggcttcgggatgccaggtgcgccaggtgtaaaggggcctccagggatgcacggccctcccggccctgttggactgccaggagtgggcaaaccaggagtgacaggcttccctgggccccagggccccctgggaaagccaggggctccaggagaacctgggccacaaggccctattggggtaccgggggttcaaggacctcctgggatacccggaattggaaagccaggccaggatgggatcccaggccagccaggatttccaggtggcaaaggggagcaaggactgccagggctaccaggacccccaggccttccagggattgggaaaccaggcttcccaggacccaaaggtgaccggggcatgggaggtgttcctggggctcttggaccaagaggggagaaaggaccaataggtgccccaggaatagggggtcctccaggagagccaggcctgcctggaatcccaggtcctatgggccctccaggtgctattggttttcctggacccaaaggagaaggtgggattgtagggccacaggggccaccaggtcccaagggtgagccagggcttcaaggcttcccaggaaagccaggtttccttggtgaagtagggcctcctggcatgaggggtttgccaggtcccatagggcccaagggggaagctgggcaaaaaggtgtaccaggactccctggtgttccagggcttctcggacctaagggagagccaggaatcccaggggatcagggtttacagggccccccaggtatcccagggattgggggccctagtggccccattggaccacctgggattccaggccccaaaggggagccgggcctcccagggccccctgggttccctggtatagggaaacccggagtggcaggacttcatggccccccagggaagcctggtgcccttggtcctcaaggccagcctggccttccaggacccccaggccctccaggacctccaggacccccagctgtgatgccccctacaccaccaccccagggagagtatctgccagatatggggctgggaattgatggcgtgaaacccccccatgcctacggggctaagaaaggcaagaatggagggccagcctatgagatgcctgcatttaccgccgagctaaccgcacctttcccaccggtgggggccccagtgaagtttaacaaactgctgtataacggcagacagaactacaacccgcagacaggcatcttcacctgtgaggtccctggtgtctactactttgcataccacgttcactgcaaggggggcaacgtgtgggttgctctattcaagaacaacgagcccgtgatgtacacgtacgacgagtacaaaaagggcttcctggaccaggcatctgggagtgcagtgctgctgctcaggcccggagaccgggtgttcctccagatgccctcagaacaggctgcaggactgtatgccgggcagtatgtccactcctccttttcaggatatttattgtatcccatgtaaaaacaaaaaaacaaaaaacaaagaaaagaaagagattttatagaagaaaatgacacaccaaaaaatccaaatgaaaaacataattgcttcaaaacacttacacagttggaaagttatatgtaagtgaaaatttggaccattgtgtacaaataaaaactaagatgcatgtttaatactccacacagcagcctgtaattgcgaatgatgggatagagttatgtatcaagtactgacacttggttgtacccactggaatcatattagctgttttatgttatatgcttccacagtaacctgcttattcagatcagtcaaaatatatcagtatgaaagatcatagctaatgaaaggcactcactcatattgtttactttaaaatatttataaatatgccttaaagaaatacaaatgataacaattacataccgtatttacttgcttaatttcctctgtatttgtgtagatactttgacatggaatatatggtggggagacccgtagtgttaccgccccagtgggagggggccctggggaccctggtaatgctttagtcaaagggatatctctcttgtatcagaggctgtgtcttttagtaacaggagtcctcgtcagaattgcgtgtctgttgtctctaaaagaatgggtgaaccaatcggcctttgtgaatttattcagtgccttctctgtaccaagcactgggtaaggcacttttgtggagcattagacagtaaccctcaaggagctagagaaccggatgggagacatgagcagtaattaactcacttgttccccagagtttctatttgttttgattttctttttctgtgacttattttcctattttctttcctccatgtaattttcactatggcccaactaatataaacacctggaaattacaaggaaaaaaaattcttcctctaataactttccaaatttgtggaatatttatttgtaatagcagttatcagttatgcttatatagcattaaaaattctcctcctttgactacacacacaaccacagtgtggttctaatcatggagatatcagtaatttttagtaactgaattttgaggacatttctctgtttagcatgtatgcaaactgatatgtaatctgaggttccaaagtcaatttttttcttttttttttgagatggagtcttactctgtcacccaggctggagtgcagtagcacgatcttggcttactgcaacctctacctcctaggttcaagcaattgtcctgtctcagcctcccgagtactgggactactgtcttgcgccaccatgcctggctaatttttgtatatttagtaaagatgggttttcgccatgttggccaggctggtctcaaactcctggcctcaagtgatgcacctgcctcagccttccaaagtgctgggattacaggcatgagccaccgtgcccggccaaagtcagctttcaaaatccaagccataattggtgaggggggagtttcagaattacatagaaaaattaatatttgaaaaaataattctgaaatttcgaatttaaaaacagatgtgctgcttctgggtgtaggtagtaaaagtataggaaaagaactgtttccttagaagcggactgtggaagggctatgtagaatgtcaaagggcaacaagagcctgtgtttttaatgtcatcctgtactcggcacaaatcaaaggccaatacaagtctgaaaagcagaaataaatatttttccaggtttttgcttgggcacatactaactgctttgggcattctaatctggtctccaaacaccaaagacccatttcgagcctgctattagcctgctgctgactctatcacttggagcaataatgtggggttatggtggtggaatcttgtatatttttgtcaaaaataaaaccatgagttaaggggatagatatagatggaaaaatacacaaataaatacggtatgaaaacacatggaaatgtgtctttgtcaaatctgaatcattattaccatcacaaaaattcttctcttggccaatatctcatttccctatatagtatacaagcaccatttcttctcaatttttaagaagagaaattagtccattaccacaggggttcttgtcactactaattatacaacaatcttttcccaacaaaaagatgtcctccacaacctttgttttcaaagcagacagcatctatgtggccaaatatactttgggttgttcttgaggatactggttttgggctgatgactatggtgggcagcatggatccattgggctccttctgctaaacagccacattgaaatggtttaaaagcaagtcagatcaggtgatttgtaaaattgtatttatctgtacatgtatgggcttttaattcccaccaagaaagagagaaattatctttttagttaaaaccaaatttcacttttcaaaatatcttccaacttatttattggttgtcactcaattgcctatatatatatatatatgtgtgtgtgtgtgtgtgtgcgcgtgagcgcacgtgtgtgtatgcgtgcgcatgtgtgtgtatgtgtattatcagacataggtttctaacttttagatagaagaggagcaacatctatgccaaatactgtgcattctacaatggtgctaatctcagacctaaatgatactccatttaatttaaaaaagagttttaaataattatctatgtgcctgtatttcccttttgagtgctgcacaacatgttaacatattagtgtaaaagcagatgaaacaaccacgtgttctaaagtctagggattgtgctataatccctatttagttcaaaattaaccagaattcttccatgtgaaatggaccaaactcatattattgttatgtaaatacagagttttaatgcagtatgacatcccacaggggaaaagaatgtctgtagtgggtgactgttatcaaatattttatagaatacaatgaacggtgaacagactggtaacttgtttgagttcccatgacagatttgagacttgtcaatagcaaatcatttttgtatttaaatttttgtactgatttgaaaaacatcattaaatatctttaaaagta

SEQ ID NO: 103 - DNA, 5515 bp, Homo sapiens
ggatcacagcccttccccgatcctctccgtgggagccagcgagcctctctccctgatcttacgtgctcaagaagctgttgtgaaggcagagcagcatctgctgaagagacagaaaccagccccagaggtgtcacaggaaggcaccagcaaggacattggtctttgatttgattcagcagtcctgtcaagtataaatgtgatggctgtgctgcctggccctctgcagctgctgggagtgctgcttaccatttccctgagttccatcaggctcattcaggctggtgcctactatgggatcaagccgctgccacctcaaattcctcctcagatgccaccacaaattccacaataccagcccctgggtcagcaagtacctcacatgcctttggccaaagatggccttgccatgggcaaggagatgccccacttgcagtatggcaaagagtatccacacctaccccaatatatgaaggaaattcaaccggcgccaagaatgggcaaggaagccgtacccaagaaaggcaaagaaataccattagccagtttacgaggggaacaaggtccccgtggagagcctggcccaagaggaccacctgggccccctggtttgccaggtcatgggatacctggaattaaaggaaaaccagggccacagggatatccaggagttggaaagccaggtatgcctggaatgccagggaagccaggagccatgggcatgcctggggcaaaaggagaaattggacagaaaggggaaattgggcctatggggatcccaggaccacaaggacctccagggcctcatggacttcctggcattgggaagccaggtgggccagggttaccagggcaaccaggaccaaagggtgatcgaggacccaaaggactaccaggacctcaaggccttcggggtcctaaaggagacaagggcttcgggatgccaggtgcgccaggtgtaaaggggcctccagggatgcacggccctcccggccctgttggactgccaggagtgggcaaaccaggagtgacaggcttccctgggccccagggccccctgggaaagccaggggctccaggagaacctgggccacaaggccctattggggtaccgggggttcaaggacctcctgggatacccggaattggaaagccaggccaggatgggatcccaggccagccaggatttccaggtggcaaaggggagcaaggactgccagggctaccaggacccccaggccttccagggattgggaaaccaggcttcccaggacccaaaggtgaccggggcatgggaggtgttcctggggctcttggaccaagaggggagaaaggaccaataggtgccccaggaatagggggtcctccaggagagccaggcctgcctggaatcccaggtcctatgggccctccaggtgctattggttttcctggacccaaaggagaaggtgggattgtagggccacaggggccaccaggtcccaagggtgagccagggcttcaaggcttcccaggaaagccaggtttccttggtgaagtagggcctcctggcatgaggggtttgccaggtcccatagggcccaagggggaagctgggcaaaaaggtgtaccaggactccctggtgttccagggcttctcggacctaagggagagccaggaatcccaggggatcagggtttacagggccccccaggtatcccagggattgggggccctagtggccccattggaccacctgggattccaggccccaaaggggagccgggcctcccagggccccctgggttccctggtatagggaaacccggagtggcaggacttcatggccccccagggaagcctggtgcccttggtcctcaaggccagcctggccttccaggacccccaggccctccaggacctccaggacccccagctgtgatgccccctacaccaccaccccagggagagtatctgccagatatggggctgggaattgatggcgtgaaacccccccatgcctacggggctaagaaaggcaagaatggagggccagcctatgagatgcctgcatttaccgccgagctaaccgcacctttcccaccggtgggggccccagtgaagtttaacaaactgctgtataacggcagacagaactacaacccgcagacaggcatcttcacctgtgaggtccctggtgtctactactttgcataccacgttcactgcaaggggggcaacgtgtgggttgctctattcaagaacaacgagcccgtgatgtacacgtacgacgagtacaaaaagggcttcctggaccaggcatctgggagtgcagtgctgctgctcaggcccggagaccgggtgttcctccagatgccctcagaacaggctgcaggactgtatgccgggcagtatgtccactcctccttttcaggatatttattgtatcccatgtaaaaacaaaaaaacaaaaaacaaagaaaagaaagagattttatagaagaaaatgacacaccaaaaaatccaaatgaaaaacataattgcttcaaaacacttacacagttggaaagttatatgtaagtgaaaatttggaccattgtgtacaaataaaaactaagatgcatgtttaatactccacacagcagcctgtaattgcgaatgatgggatagagttatgtatcaagtactgacacttggttgtacccactggaatcatattagctgttttatgttatatgcttccacagtaacctgcttattcagatcagtcaaaatatatcagtatgaaagatcatagctaatgaaaggcactcactcatattgtttactttaaaatatttataaatatgccttaaagaaatacaaatgataacaattacataccgtatttacttgcttaatttcctctgtatttgtgtagatactttgacatggaatatatggtggggagacccgtagtgttaccgccccagtgggagggggccctggggaccctggtaatgctttagtcaaagggatatctctcttgtatcagaggctgtgtcttttagtaacaggagtcctcgtcagaattgcgtgtctgttgtctctaaaagaatgggtgaaccaatcggcctttgtgaatttattcagtgccttctctgtaccaagcactgggtaaggcacttttgtggagcattagacagtaaccctcaaggagctagagaaccggatgggagacatgagcagtaattaactcacttgttccccagagtttctatttgttttgattttctttttctgtgacttattttcctattttctttcctccatgtaattttcactatggcccaactaatataaacacctggaaattacaaggaaaaaaaattcttcctctaataactttccaaatttgtggaatatttatttgtaatagcagttatcagttatgcttatatagcattaaaaattctcctcctttgactacacacacaaccacagtgtggttctaatcatggagatatcagtaatttttagtaactgaattttgaggacatttctctgtttagcatgtatgcaaactgatatgtaatctgaggttccaaagtcaatttttttcttttttttttgagatggagtcttactctgtcacccaggctggagtgcagtagcacgatcttggcttactgcaacctctacctcctaggttcaagcaattgtcctgtctcagcctcccgagtactgggactactgtcttgcgccaccatgcctggctaatttttgtatatttagtaaagatgggttttcgccatgttggccaggctggtctcaaactcctggcctcaagtgatgcacctgcctcagccttccaaagtgctgggattacaggcatgagccaccgtgcccggccaaagtcagctttcaaaatccaagccataattggtgaggggggagtttcagaattacatagaaaaattaatatttgaaaaaataattctgaaatttcgaatttaaaaacagatgtgctgcttctgggtgtaggtagtaaaagtataggaaaagaactgtttccttagaagcggactgtggaagggctatgtagaatgtcaaagggcaacaagagcctgtgtttttaatgtcatcctgtactcggcacaaatcaaaggccaatacaagtctgaaaagcagaaataaatatttttccaggtttttgcttgggcacatactaactgctttgggcattctaatctggtctccaaacaccaaagacccatttcgagcctgctattagcctgctgctgactctatcacttggagcaataatgtggggttatggtggtggaatcttgtatatttttgtcaaaaataaaaccatgagttaaggggatagatatagatggaaaaatacacaaataaatacggtatgaaaacacatggaaatgtgtctttgtcaaatctgaatcattattaccatcacaaaaattcttctcttggccaatatctcatttccctatatagtatacaagcaccatttcttctcaatttttaagaagagaaattagtccattaccacaggggttcttgtcactactaattatacaacaatcttttcccaacaaaaagatgtcctccacaacctttgttttcaaagcagacagcatctatgtggccaaatatactttgggttgttcttgaggatactggttttgggctgatgactatggtgggcagcatggatccattgggctccttctgctaaacagccacattgaaatggtttaaaagcaagtcagatcaggtgatttgtaaaattgtatttatctgtacatgtatgggcttttaattcccaccaagaaagagagaaattatctttttagttaaaaccaaatttcacttttcaaaatatcttccaacttatttattggttgtcactcaattgcctatatatatatatatatgtgtgtgtgtgtgtgtgtgcgcgtgagcgcacgtgtgtgtatgcgtgcgcatgtgtgtgtatgtgtattatcagacataggtttctaacttttagatagaagaggagcaacatctatgccaaatactgtgcattctacaatggtgctaatctcagacctaaatgatactccatttaatttaaaaaagagttttaaataattatctatgtgcctgtatttcccttttgagtgctgcacaacatgttaacatattagtgtaaaagcagatgaaacaaccacgtgttctaaagtctagggattgtgctataatccctatttagttcaaaattaaccagaattcttccatgtgaaatggaccaaactcatattattgttatgtaaatacagagttttaatgcagtatgacatcccacaggggaaaagaatgtctgtagtgggtgactgttatcaaatattttatagaatacaatgaacggtgaacagactggtaacttgtttgagttcccatgacagatttgagacttgtcaatagcaaatcatttttgtatttaaatttttgtactgatttgaaaaacatcattaaatatctttaaaagta

SEQ ID NO: 104 - DNA, 4524 bp, Homo sapiens
actccggcagccgcgaggggcggccggcagagcgacgcggaaccccgccggcgcggaccccggaccccaacgccgcccgcccagccgcggacgcccctgcccggagccctcgccgcccgggccgccctcgagggccgggagcggcgcccggcggccgcgcccgcaggccctgcctctgctggaaccttcccaggcccctccgacctgaaagcacgtccacggacgccatgctggggactctgacacccctgtcttcgctgctgctgctgctactgaaatgcctctaccgctgctgccgatggacctgaagggagagcccggcccccctgggaagcccgggcctcggggtccccctggcccccctggcttcccaggaaaaccaggcatgggaaagccaggactccatgggcagcctggccctgctgggccccctggcttctcccggatgggcaaggctggtcccccagggctccctggcaaggtcgggccaccagggcagccggggcttcggggggagccaggaatacgaggggaccagggcctccggggacccccaggaccccctggcctcccgggcccctcaggcattactatccctggaaaaccaggtgcccaaggggtgccagggcccccaggattccagggggaaccagggccccagggggagcctgggcccccaggtgatcgaggcctcaagggggataatggagtgggccagcccgggctgcctggggccccagggcaggggggtgcccccggcccccccggcctccctggtccagctggcttaggcaaacctggtttggatgggcttcctggggccccaggagacaagggtgagtctgggcctcctggagttccaggccccaggggggagccaggagctgtgggcccaaaaggacctcctggagtagacggtgtgggagtcccaggggcagcagggttgccaggaccacagggcccatcaggggccaaaggggagccagggacccggggcccccctgggctgataggccccactggctatgggatgccaggactgccaggccccaagggggacaggggcccagctggggtcccaggactcttgggggacaggggtgagccaggggaggatggggagccaggggagcagggcccacagggtcttgggggtccccctggacttcctgggtctgcagggcttcctggcagacgtgggccccctgggcctaagggtgaggcagggcctggaggacccccaggagtgcctggcattcgaggtgaccaggggcctagtggcctggctgggaaaccaggggtcccaggtgagaggggacttcctggggcccatggaccccctggaccaactgggcccaagggtgagccgggtttcacgggtcgccctggaggaccaggggtggcaggagccctggggcagaaaggtgacttggggctccctgggcagcctggcctgaggggtccctcaggaatcccaggactccagggtccagctggccctattgggccccaaggcctgccgggcctgaagggggaaccaggcctgccagggccccctggagaggggagagcaggggaacctggcacggctgggcccacggggcccccaggggtccctggctcccctggaatcacgggccctccggggcctcccgggcccccgggaccccctggtgcccctggggccttcgatgagactggcatcgcaggcttgcacctgcccaacggcggtgtggagggtgccgtgctgggcaaggggggcaagccacagtttgggctgggcgagctgtctgcccatgccacaccggccttcactgcggtgctcacctcgcccttccccgcctcgggcatgcccgtgaaatttgaccggactctctacaatggccacagcggctacaacccagccactggcatcttcacctgccctgtgggcggcgtctactactttgcttaccatgtgcacgtcaagggcaccaacgtgtgggtggccctgtacaagaacaacgtgccggccacctatacctacgatgagtacaagaagggctacctggaccaggcatctggtggggccgtgctccagctgcggcccaacgaccaggtctgggtgcagatgccgtcggaccaggccaacggcctctactccacggagtacatccactcctccttttcaggattcttgctctgccccacataacccgcggggggggtcctgctgccctggcctcctcccctttagtggtagagcgaccttttcaattacaaagaacctcctggaaaaaaaaacaaaagctgaacagaggcggccgtggccttggcccgaggagactaacttgctttctccctgcatgcaggctgagattgtttctggaaggggctggcctgagtttctttcccccaaatgtctgtgcagtgtcagggctgcaccccataggccctgaggcacacagcccagccccttgtgagtcctggcctctgctgggccctgaaggagctgagagggagctcaactccccaccccgccacgtggggagacagcccttcccactggctccctgatggcacctgctggaggaaaggggcacggcctccctcacagcccttggctggggctcctccagctccccctgggacctccagcatatgacagtggactaaggactgtggggttttcctccaaggggaagggagaagaggggaccatcgaggtggcgagtgtggacaccctgccaggactgcagcccccatggtgatgctgtggcatcagacatgtccgtggtgggcacagtgcctgttgccctgggaaagggcaacctccctttcactgctccagtggcagccatggggaaggcagtttgtgagggcttggggcacagacctggggcaggaggcagctcttcacgttcatccctgtctctcccgggctgcccccgccagctctggctgtttagcttgagggcagcacagaggcccctgggacacctacaggccagaaagatcaacctctgtgaagtgtctagaagtatctagtgcagatggtggcggaggcagaatcgaccatcagcaaacatgagcactcttccctttctccccttccacctgctgcgggctgggctggttttctcaatacaaaattgtaagaggatccttgtcaccccagccaggtatccccaaggcagagcacctctcgtttggccctctgaacaaggtgcacgcgagctgggggatgaagacggctcccacttccttttccttaataagaaccatatggtgggtgtatgtgtgtacaagaggggttcatctgtgggggcttcctctccttccaccctctggttccaatttcctgttctaagcaggactagggcccaggaggctaaggctgggagagaaagggtgccaacaggtcccttgggaatgagttggctctggacgtttctgccctgttccccgatcagagctcctctgcaggaaacaggcaggatgcccctcccaacccctcagtccctacgtcaagcggagtggataaggctgagatgagtgctgggagtggtggacattcctgctcgtgcaaagatggccactttccccgcagctgcagggcctcgcgctcggccctcgccaggccagccccactccttgtaccaagtgtgaactggggtcattcggtctgtgatctcgttgcactgctccaagtctggctgtgtccaggcggtccatgttgaaaatggaggatggctgctgacttctgactggctgagcagtgggttccttcaggttccttgccaaccctcctcccctgcccacaacttctccaaacaaagcaggctgtttgctcacttcttcaaaaggaggaatgataacccaaatctgcccaagtgacacttgagaaggttttggctggggttcctggtggatttcttactacctaacgcccaagaaaaccaactaaggactctcaaaccatacctggtgggggttcttcgctcaacctcttcttccctaggtcaaagccactatcatctgatgtgttagggatgggttctgattggcagaaattaatcagctcccaatgggagcccacggaactaagtagggtcccaagaaaaaaaacgggagctatttcacagagctgagcttctgccaaatttcattcctcaaacctttcaggaggggtggttggcgtttctaaaatgtttatgggatttgagttgcaggtgtccacttaactgactagctttgataaacaatgtcagattttaactatgaaaacgacattaccttgtgcatttttatattgattcctattttttttttaagattaaagtttaaatgttttccactagtcatttcacttctaacttggtataggaagcttagctctctacatacctatcatgtgccctgtatcacagaagattcaggaaaaatgcacttgggaatcaaagaaaatggaacttctttttgaaaagacaagcaaccatgttaactgtattgacacatcctcaataaaacctgttgtataaaaca

SEQ ID NO: 105 - DNA, 4669 bp, Homo sapiens
actccggcagccgcgaggggcggccggcagagcgacgcggaaccccgccggcgcggaccccggaccccaacgccgcccgcccagccgcggacgcccctgcccggagccctcgccgcccgggccgccctcgagggccgggagcggcgcccggcggccgcgcccgcaggccctgcctctgctggaaccttcccaggcccctccgacctgaaagcacgtccacggacgccatgctggggactctgacacccctgtcttcgctgctgctgctgctactggtgctggtgctggggtgtgggccgcgggcgtcctctggtggcggggccggtggggcggcgggctatgccccagtgaagtacatccagcccatgcagaaaggacctgtgggaccgcccttccgtgagggcaaaggccagtacctggaaatgcctctaccgctgctgccgatggacctgaagggagagcccggcccccctgggaagcccgggcctcggggtccccctggcccccctggcttcccaggaaaaccaggcatgggaaagccaggactccatgggcagcctggccctgctgggccccctggcttctcccggatgggcaaggctggtcccccagggctccctggcaaggtcgggccaccagggcagccggggcttcggggggagccaggaatacgaggggaccagggcctccggggacccccaggaccccctggcctcccgggcccctcaggcattactatccctggaaaaccaggtgcccaaggggtgccagggcccccaggattccagggggaaccagggccccagggggagcctgggcccccaggtgatcgaggcctcaagggggataatggagtgggccagcccgggctgcctggggccccagggcaggggggtgcccccggcccccccggcctccctggtccagctggcttaggcaaacctggtttggatgggcttcctggggccccaggagacaagggtgagtctgggcctcctggagttccaggccccaggggggagccaggagctgtgggcccaaaaggacctcctggagtagacggtgtgggagtcccaggggcagcagggttgccaggaccacagggcccatcaggggccaaaggggagccagggacccggggcccccctgggctgataggccccactggctatgggatgccaggactgccaggccccaagggggacaggggcccagctggggtcccaggactcttgggggacaggggtgagccaggggaggatggggagccaggggagcagggcccacagggtcttgggggtccccctggacttcctgggtctgcagggcttcctggcagacgtgggccccctgggcctaagggtgaggcagggcctggaggacccccaggagtgcctggcattcgaggtgaccaggggcctagtggcctggctgggaaaccaggggtcccaggtgagaggggacttcctggggcccatggaccccctggaccaactgggcccaagggtgagccgggtttcacgggtcgccctggaggaccaggggtggcaggagccctggggcagaaaggtgacttggggctccctgggcagcctggcctgaggggtccctcaggaatcccaggactccagggtccagctggccctattgggccccaaggcctgccgggcctgaagggggaaccaggcctgccagggccccctggagaggggagagcaggggaacctggcacggctgggcccacggggcccccaggggtccctggctcccctggaatcacgggccctccggggcctcccgggcccccgggaccccctggtgcccctggggccttcgatgagactggcatcgcaggcttgcacctgcccaacggcggtgtggagggtgccgtgctgggcaaggggggcaagccacagtttgggctgggcgagctgtctgcccatgccacaccggccttcactgcggtgctcacctcgcccttccccgcctcgggcatgcccgtgaaatttgaccggactctctacaatggccacagcggctacaacccagccactggcatcttcacctgccctgtgggcggcgtctactactttgcttaccatgtgcacgtcaagggcaccaacgtgtgggtggccctgtacaagaacaacgtgccggccacctatacctacgatgagtacaagaagggctacctggaccaggcatctggtggggccgtgctccagctgcggcccaacgaccaggtctgggtgcagatgccgtcggaccaggccaacggcctctactccacggagtacatccactcctccttttcaggattcttgctctgccccacataacccgcggggggggtcctgctgccctggcctcctcccctttagtggtagagcgaccttttcaattacaaagaacctcctggaaaaaaaaacaaaagctgaacagaggcggccgtggccttggcccgaggagactaacttgctttctccctgcatgcaggctgagattgtttctggaaggggctggcctgagtttctttcccccaaatgtctgtgcagtgtcagggctgcaccccataggccctgaggcacacagcccagccccttgtgagtcctggcctctgctgggccctgaaggagctgagagggagctcaactccccaccccgccacgtggggagacagcccttcccactggctccctgatggcacctgctggaggaaaggggcacggcctccctcacagcccttggctggggctcctccagctccccctgggacctccagcatatgacagtggactaaggactgtggggttttcctccaaggggaagggagaagaggggaccatcgaggtggcgagtgtggacaccctgccaggactgcagcccccatggtgatgctgtggcatcagacatgtccgtggtgggcacagtgcctgttgccctgggaaagggcaacctccctttcactgctccagtggcagccatggggaaggcagtttgtgagggcttggggcacagacctggggcaggaggcagctcttcacgttcatccctgtctctcccgggctgcccccgccagctctggctgtttagcttgagggcagcacagaggcccctgggacacctacaggccagaaagatcaacctctgtgaagtgtctagaagtatctagtgcagatggtggcggaggcagaatcgaccatcagcaaacatgagcactcttccctttctccccttccacctgctgcgggctgggctggttttctcaatacaaaattgtaagaggatccttgtcaccccagccaggtatccccaaggcagagcacctctcgtttggccctctgaacaaggtgcacgcgagctgggggatgaagacggctcccacttccttttccttaataagaaccatatggtgggtgtatgtgtgtacaagaggggttcatctgtgggggcttcctctccttccaccctctggttccaatttcctgttctaagcaggactagggcccaggaggctaaggctgggagagaaagggtgccaacaggtcccttgggaatgagttggctctggacgtttctgccctgttccccgatcagagctcctctgcaggaaacaggcaggatgcccctcccaacccctcagtccctacgtcaagcggagtggataaggctgagatgagtgctgggagtggtggacattcctgctcgtgcaaagatggccactttccccgcagctgcagggcctcgcgctcggccctcgccaggccagccccactccttgtaccaagtgtgaactggggtcattcggtctgtgatctcgttgcactgctccaagtctggctgtgtccaggcggtccatgttgaaaatggaggatggctgctgacttctgactggctgagcagtgggttccttcaggttccttgccaaccctcctcccctgcccacaacttctccaaacaaagcaggctgtttgctcacttcttcaaaaggaggaatgataacccaaatctgcccaagtgacacttgagaaggttttggctggggttcctggtggatttcttactacctaacgcccaagaaaaccaactaaggactctcaaaccatacctggtgggggttcttcgctcaacctcttcttccctaggtcaaagccactatcatctgatgtgttagggatgggttctgattggcagaaattaatcagctcccaatgggagcccacggaactaagtagggtcccaagaaaaaaaacgggagctatttcacagagctgagcttctgccaaatttcattcctcaaacctttcaggaggggtggttggcgtttctaaaatgtttatgggatttgagttgcaggtgtccacttaactgactagctttgataaacaatgtcagattttaactatgaaaacgacattaccttgtgcatttttatattgattcctattttttttttaagattaaagtttaaatgttttccactagtcatttcacttctaacttggtataggaagcttagctctctacatacctatcatgtgccctgtatcacagaagattcaggaaaaatgcacttgggaatcaaagaaaatggaacttctttttgaaaagacaagcaaccatgttaactgtattgacacatcctcaataaaacctgttgtataaaaca

SEQ ID NO: 106 - DNA, 2536 bp, Homo sapiens
agctctcagagggaattgagcacccggcagcggtctcaggccaagccccctgccagcatggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccaggagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtc

SEQ ID NO: 107 - DNA, 2754 bp, Homo sapiens
agctctcagagggaattgagcacccggcagcggtctcaggccaagccccctgccagcatggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtgtacatgtgtgcagagcagacaggctacaaagcagagatcgacagacagccaggtagttggaactttctgttccctatggagaggcttccctacacagggcctgctattgcagaatgaagccatttagagggtgaaggagaaatacccatgttacttctctgagttttagttggtctttccatctatcactgcattatcttgctcattcttcagttctctactccctcttgtcagtgtagacacaggtcaccattatgctggtgtatgtttatcaaagagcacttgagctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatgttaagaaaataaaggaaaatgacttgtaaggtc

SEQ ID NO: 108 - DNA, 3670 bp, Homo sapiens
ggagctgcggcggggtctggggcgcagagcagcggcgggaggaggcggacacgtggcaacagcggtagcagcccgggcggcggcagcaacagcggcggcggcatcggcccgagccgccggccgccctcccaccctcccgccccgcggcagccctagctccctccacttggctcccctggtcccgctcgctcggccgggagctgctctgtgcttttctctctgattctccagcgacaggacccggcgccgggcactgagcaccgccaccatggggaagggggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatggaa

SEQ ID NO: 109 - DNA, 3765 bp, Homo sapiens
agcagcgggggcggccccgggactgagccggcatccctgagcctggctcccctccctgcgaccgccgtcacctccttctccttccttttccctccgccctccgtgccctgaggaaaggcgcgctcctccccttcccctggggcgctccgccggggcctcctcccgggcctccgttcccgccgcggccccggttccggcgggggcagcctccgggttcggggctccttctcctggggacgctggggcttagcttgctccgcgcagaggcggccgccctcccccaaagaaaaaactggctgcttctaagtgcgaagccggctgggcgggctggtgccagaaagggtgtgtcttcactgccctaagatggcctttaaggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatggaa

SEQ ID NO: 110 - DNA, 3574 bp, Homo sapiens
gatatgtaataatgtctttgcaaagcaaagaatataaacagtataaaagtactagcatttagatgtattgtatcatttaatccttaaaaacatgaaatgaggttggcactattctttatctccacgctgtggaagaggaaattgaaatgtagaagttagtaacttgcctaaggatacactgctggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatggaa

SEQ ID NO: 111 - DNA, 8024 bp, Homo sapiens
gccgccgggccacggcctgcaggggtggaaggggcggcggcggcgggagctgcgggccacgcacggcggcggcggcgggagcggccgggcacgcacggcgacggcggcggcgggagcgggagcccgggccacgcacggccgcagctgcgggtgcggcgggcgcgggagcggtgggagctgtggtggcggcggatggcccagagctgatctatgcggcgcctggaggggctgtgtctgcggcggcggcggaggcggcggggccctgcccgcgagcggagcggggacaagatgaagtaccagaaatacctgacggtgctgcagatggccatcggcgtcaccccctccaaccgcggcagcctcctgccgctcaagaggaagctgtgggtaacgccatcctctgaaaatcctaatggtgctacttctagtgtcagccaaggaaaaccctctttaagacgaattaaagggagattacacagaagcaaaagccttgatagcatggatttctgtgagctcactagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgccgccagccatctctccgagcctgcaaagccagcgcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggttggtcttttgctctaaaatcatccgactcctcgtcgggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttctttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 112 - DNA, 7480 bp, Homo sapiens
actccactcagcctgtgaggcgtagtaggtcgggttttctttcatgctgtattacttatttaaggaggaaaggctttgtttccgtattacacagaatgtcactttgttcctgaagtgtgatctctggtacttaatatgcaagacaacacactttttaagaggttatttcaagtatggagagaaatacgttttcaatggattgccacagtaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgccgccagccatctctccgagcctgcaaagccagcgcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggttggtcttttgctctaaaatcatccgactcctcgtcgggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttctttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 113 - DNA, 7190 bp, Homo sapiens
gtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgccgccagccatctctccgagcctgcaaagccagcgcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggttggtcttttgctctaaaatcatccgactcctcgtcgggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttctttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaa

SEQ ID NO: 114 - DNA, 7964 bp, Homo sapiens
gccgccgggccacggcctgcaggggtggaaggggcggcggcggcgggagctgcgggccacgcacggcggcggcggcgggagcggccgggcacgcacggcgacggcggcggcgggagcgggagcccgggccacgcacggccgcagctgcgggtgcggcgggcgcgggagcggtgggagctgtggtggcggcggatggcccagagctgatctatgcggcgcctggaggggctgtgtctgcggcggcggcggaggcggcggggccctgcccgcgagcggagcggggacaagatgaagtaccagaaatacctgacggtgctgcagatggccatcggcgtcaccccctccaaccgcggcagcctcctgccgctcaagaggaagctgtgggtaacgccatcctctgaaaatcctaatggtgctacttctagtgtcagccaaggaaaaccctctttaagacgaattaaagggagattacacagaagcaaaagccttgatagcatggatttctgtgagctcactagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgccgccagccatctctccgagcctgcaaagccagcgcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttctttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 115 - DNA, 7638 bp, Homo sapiens
gaggaaaggctttgtttccgtattacacagaatgtcactttgttcctgaagtgtgatctctggtacttaatatgcaagacaacacactttttaagaggttatttcaagtatggagagaaatacgttttcaatggattgccacagtaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgccgccagccatctctccgagcctgcaaagccagcgcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttctttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaataaaaaaaaaaaaaaaaaaaaaa

SEQ ID NO: 116 - DNA, 7936 bp, Homo sapiens
gtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgccgccagccatctctccgagcctgcaaagccagcgcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttctttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 117 - DNA, 7735 bp, Homo sapiens
gtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgccgccagccatctctccgagcctgcaaagccagcgcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgcgtccatgactcctgacggttggtcttttgctctaaaatcatccgactcctcgtcgggtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttctttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 118 - DNA, 7915 bp, Homo sapiens
gtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacagaaagcagaagcttcatctccagtcccttacctttcgcctgaaacaaacccagcatcatcaacctctgctgttaatcataatgtaaatttaactaatgtcagactggaggagcccaccccagctccttccacctcttactcaccacaagctgattctttaagaacaccaagtactgaggcagctcacataatgctaagagatcaagaaccatcattgtcgtcgcatgtagatccaacaaaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgccgccagccatctctccgagcctgcaaagccagcgcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttctttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 119 - DNA, 7675 bp, Homo sapiens
gtggccgctgagttgccggcgccggctgagccagcggacgccgcgttccttggcggccgccggttcccgggaagttacgtggcgaagccggcttccgaggagacgccgggaggccacgggtgctgctgacgggcgggcgaccgggcgaggccgacgtggccgggctgcgaaagctgcgggaggccgagtgggtggccgcgctcggagggaggtgccggtcgggcgcgccccgtggagaagacccgggcggggcgggcgcttcccggacttttgtccgagttgaattccctccccctgggccgggcccttccggccgcccccgcccgtgccccgctcgctctcgggagatgtttatttgggctgtggcgtgaggagcgggcgggccagcgccgcggagtttcgggtccgaggagcctcgcgcggcgctggagagagacaagatgtccgccagagctgcggccgccaagagcacagcaatggaggaaacagctatatgggaacaacatacagtgacgcttcacagggctcctggatttggatttggaattgcaatatctggtggacgagataatcctcattttcagagtggggaaacgtcaatagtgatttcagatgtgctgaaaggaggaccagctgaaggacagctacaggaaaatgaccgagttgcaatggttaacggagtttcaatggataatgttgaacatgcttttgctgttcagcaactaaggaaaagtgggaaaaatgcaaaaattacaattagaaggaagaagaaagttcaaataccagtaagtcgtcctgatcctgaaccagtatctgataatgaagaagatagttatgatgaggaaatacatgatccaagaagtggccggagtggtgtggttaacagaaggagtgagaagatttggccgagggatagaagtgcaagtagagagaggagcttgtccccgcggtcagacaggcggtcagtggcttccagccagcctgctaaacctactaaagtcacactggtgaaatcccggaaaaatgaagaatatggtcttcgattggcaagccatatatttgttaaggaaatttcacaagatagtttggcagcaagagatggcaatattcaagaaggtgatgttgtattgaagataaatggtactgtgacagaaaatatgtcattgacagatgcaaagacattgatagaaaggtctaaaggcaaattaaaaatggtagttcaaagagatgaacgggctacgctattgaatgtccctgatctttctgacagcatccactctgctaatgcctctgagagagacgacatttcagaaattcagtcactggcatcagatcattctggtcgatcacacgataggcctccccgccgcagccggtcacgatctcctgaccagcggtcagagccttctgatcattccaggcactcgccgcagcagccaagcaatggcagtctccggagtagagatgaagagagaatttctaaacctggggctgtctcaactcctgtaaagcatgctgatgatcacacacctaaaacagtggaagaagttacagttgaaagaaatgagaaacaaacaccttctcttccagaaccaaagcctgtgtatgcccaagttgggcaaccagatgtggatttacctgtcagtccatctgatggtgtcctacctaattcaactcatgaagatgggattcttcggcccagcatgaaattggtaaaattcagaaaaggagatagtgtgggtttgcggctggctggtggaaatgatgttggaatatttgtagctggcgttctagaagatagccctgcagccaaggaaggcttagaggaaggtgatcaaattctcagggtaaacaacgtagattttacaaatatcataagagaagaagccgtccttttcctgcttgacctccctaaaggagaagaagtgaccatattggctcagaagaagaaggatgtttatcgtcgcattgtagaatcagatgtaggagattctttctatattagaacccattttgaatatgaaaaggaatctccctatggacttagttttaacaaaggagaggtgttccgtgttgtggataccttgtacaatggaaaactgggctcttggcttgctattcgaattggtaaaaatcataaggaggtagaacgaggcatcatccctaataagaacagagctgagcagctagccagtgtacagtatacacttccaaaaacagcaggcggagaccgtgctgacttctggagattcagaggtcttcgcagctccaagagaaatcttcgaaaaagcagagaggatttgtccgctcagcctgttcaaacaaagtttccagcttatgaaagagtggttcttcgagaagctggatttctgaggcctgtaaccatttttggaccaatagctgatgttgccagagaaaagctggcaagagaagaaccagatatttatcaaattgcaaagagtgaaccacgagacgctggaactgaccaacgtagctctggcattattcgcctgcatacaataaagcaaatcatagatcaagacaaacatgctttattagatgtaacaccaaatgcagttgatcgtcttaactatgcccagtggtatccaattgttgtatttcttaaccctgattctaagcaaggagtaaaaacaatgagaatgaggttatgtccagaatctcggaaaagtgccaggaagttatacgagcgatctcataaacttcgtaaaaataatcaccatctttttacaactacaattaacttaaattcaatgaatgatggttggtatggtgcgctgaaagaagcaattcaacaacagcaaaaccagctggtatgggtttccgagggaaaggcggatggtgctacaagtgatgaccttgatttgcatgatgatcgtctgtcctacctgtcagctccaggtagtgaatactcaatgtatagcacggacagtagacacacttctgactatgaagacacagacacagaaggcggggcctacactgatcaagaactagatgaaactcttaatgatgaggttgggactccaccggagtctgccattacacggtcctctgagcctgtaagagaggactcctctggaatgcatcatgaaaaccaaacatatcctccttactcaccacaagcgcagccacaaccaattcatagaatagactcccctggatttaagccagcctctcaacaggtgtatagaaaggatccatatcccgaggaaatgatgaggcagaaccatgttttgaaacagccagccgttagtcacccagggcacaggccagacaaagagcctaatctgacctatgaaccccaactcccatacgtagagaaacaagccagcagagacctcgagcagcccacatacagatacgagtcctcaagctatacggaccagttttctcgaaactatgaacatcgtctgcgatacgaagatcgcgtccccatgtatgaagaacagtggtcatattatgatgacaaacagccctacccatctcggccaccttttgataatcagcactctcaagaccttgactccagacagcatcccgaagagtcctcagaacgagggtactttccacgttttgaagagccagcccctctgtcttacgacagcagaccacgttacgaacaggcacctagagcatccgccctgcggcacgaagagcagccagctcctgggtatgacacacatggtagactcagaccggaagcccagccccacccttcagcagggcccaagcctgcagagtccaagcagtattttgagcaatattcacgcagttacgagcaagtaccaccccaaggatttacctctagagcaggtcattttgagcctctccatggtgctgcagctgtccctccgctgataccttcatctcagcataagccagaagctctgccttcaaacaccaaaccactgcctccacccccaactcaaaccgaagaagaggaagatccagcaatgaagccacagtctgtactcaccagagttaagatgtttgaaaacaaaagatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctgaagatattgttcggtccaatcattatgaccctgaagaagatgaagaatattatcgaaaacagctgtcatactttgaccgaagaagttttgagaataagcctcctgcacacattgccgccagccatctctccgagcctgcaaagccagcgcattctcagaatcaatcaaatttttctagttattcttcaaagggaaagcctcctgaagctgatggtgtggatagatcatttggcgagaaacgctatgaacccatccaggccactccccctcctcctccattgccctcgcagtatgcccagccatctcagcctgtcaccagcgcgtctctccacatacattctaagggagcacatggtgaaggtaattcagtgtcattggattttcagaattccttagtgtccaaaccagacccacctccatctcagaataagccagcaactttcagaccaccaaaccgagaagatactgctcaggcagctttctatccccagaaaagttttccagataaagccccagttaatggaactgaacagactcagaaaacagtcactccagcatacaatcgattcacaccaaaaccatatacaagttctgcccgaccatttgaacgcaagtttgaaagtcctaaattcaatcacaatcttctgccaagtgaaactgcacataaacctgacttgtcttcaaaaactcccacttctccaaaaactcttgtgaaatcgcacagtttggcacagcctcctgagtttgacagtggagttgaaactttctctatccatgcagagaagcctaaatatcaaataaataatatcagcacagtgcctaaagctattcctgtgagtccttcagctgtggaagaggatgaagatgaagatggtcatactgtggtggccacagcccgaggcatatttaacagcaatgggggcgtgctgagttccatagaaactggtgttagtataattatccctcaaggagccattcccgaaggagttgagcaggaaatctatttcaaggtctgccgggacaacagcatccttccacctttagataaagagaaaggtgaaacactgctgagtcctttggtgatgtgtggtccccatggcctcaagttcctgaagcctgtggagctgcgcttaccacactgtgatcctaaaacctggcaaaacaagtgtcttcccggagatccaaattatctcgttggagcaaactgtgtttctgtccttattgaccacttttaactcttgaaatataggaacttaaataatgtgaaactggattaaacttaatctaaatggaaccactctatcaagtattataccttttttagagttgatactacagtttgttagtatgaggcatttgtttgaactgataaagatgagtgagcatgcccctgaaccatggtcggaaaacatgctacacactgcatgtttgtgattgacgggactgttggtattggctagaggttcaaagatattttgctttgtgatttttgtaatttttttatcgtcactgcttaacttcacatattgatttccgttaaaataccagccagtaaatgggggtgcatttgaggtctgttctttccaaagtacactgtttcaaactttactatggccctggcctagcatacgtacacattttattttattatgcatgaagtaatatgcacacattttttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagatactgtatcatgacaaagactgagtacgttgtgcatttggtggtttcagaaatgtgttatcacccagaagaaaatagtggtgtgatttggggatatttttttcttttcttttcttttctttttttttttttttgacaaggggcagtggtggttttctgttctttctggctatgcatttgaaaattttgatgttttaaggatgcttgtacataatgcgtgcataccacttttgttcttggtttgtaaattaacttttataaactttaccttttttatacataaacaagaccacgtttctaaaggctacctttgtattctctcctgtacctcttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaatcattaggtgtgactgaatttcttttgccgttattaaaaatctcaaatttctaaatctccaaaataaaactttttaaaataaagtgctggcttggtctgtttgcccactgttttctagtttcatgcagctttataatcctgttttaaaatcctgcacacaaatccctatcacccagcgtcacctaccacctcgtcgtctggtgttgcatgcagaatttctccccttggccagcatgtacagatgggtgggcagtgctcatctgaagggctcagactgaagtggggcagaaggacctggagacagagtgggagaaggcagcaggccgacttccccctgtgggtaaacacacacccctgcgtggagaaacacccctgcatggggacacacgtgcgtttgtgtgtgtgcgtgtaaccatttgtatatggttttattccccagataaatagcacgggcattgtttaatgtcacccacatttgggggaagaaaatgggtttagtgagcataaatattccattgtggacatcctacttacttaactgccacccctgttgacatttggattattgctatagtgtttcagtaaacacctttgtggactgaatccatctatgtggattttatttttttcatctttgttaaggtataatttacatagagtaagttactgtttttaaaatgtatagttcaaattttgacaaacacatactgtttatttaccacggttaatacatacaacagtttctttatcttctctaatcatttgtacccctttatactcaacccttcttccagcccctggcaggatgatctcttctgtttctatagttgcctttttgacagtgtcatataaatggaatcatacaata

SEQ ID NO: 120 - DNA, 5789 bp, Homo sapiens
actcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttcttttacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattgaaagaaaaaagcta

SEQ ID NO: 121 - DNA, 4751 bp, Homo sapiens
actcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccatagccctcctccaccggcatctgctagctcgtctacccctgttccattgtctccaccagatacaacttggcctcttcctgcccttgcaaccacagaaccagctaaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttaggaacttgaacacaaaaattaaatttgcttaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctctttctttaaatgctatttttaaaaaccatcatgctagatttacagagaagtttctgcatatctgctacttgttgcattttgggttcaaacctaaatatgatgtagcagaggaagaattctaagtaccttctaaagcttgtgtcagattgttaaaatcaccacacattcccctcattctaactctgtgctccttgtcctcccttcaataataattggctttgcttgcaattaagcatttaagtgcccatgttaaaagagccagaccgcactgattcacatgagcgttttgctgacatgatgggcaactgaagtcacccctgttgcccatgcactggaaaaaaagttgaatttgttggatattttctggggctgatgaacgttctgggatgtgctttcagtcctcgtattacggccagcaccttacactgtctctgtgaacggggccaagccatgatgtgccaacaagtgtcagctttgaaaggtgtttgtctcccaatcggggtgactcccctgctgcctggcagcatgtcgcagatcagcacagagtggggccgtggttcagcagtgacccacagaatggctttgagcatcagtctacaggacaggttggaagcatccactgtgaaccaggcattagtcccctacctggcctgtgtgtgctcagtagagaaggagagggacaggccactcccagactgcccagcccaggagggttaataaattggggccgagccaacctgtcagtgcttcctgaatgccccagcctctgtattggtgcgttggttcagtgacattttctaaactctcctgaaaatccagctgctcctccctgctgcttgggagttcacccaggagaggaaatgggtgtgttttgttaaggtcccttgtggagactcagggctgaatcctgcttggtaatatcagtgtgtgtgcttggggatggaccttctactgaataaaaactccctccctccccccattgtggtcacatatcattctacatatctcatctctgagcatctccatggaagcttgatttttgttctttttggtttctttatgtatttttttctgttgttattattttttaatgttcaaagactagcctttccctttgggattccaaatgatcccatgctgtggtctgaggggcaaagccacctatgttggcgctcgccattaatccccagcgctcagtttagaggctcacgtgcagacatcagaggctccatgctgcacagtagctcaggcagggtagtgcctctcaacccagccacaaaactctccccgctggagtcccagatggcgcttcacaccagggcagtggaggcaggcatggtttttgggcacagggcagagcataaggatcccaggtcagtgtgggagagctactggctcttaggatcaccttgggcagaagtcacacggcttcatcctaggagggcccagcttgggagtctgcctccccctgatcccaggaccacccacaggagaggggcagtgtccatctttctgaagggaccctttggagatctcgtcctaagtgtggagaggactgacgtggccctgtcatctcaacacatcccagggtcaggcaggcctcagctgaaacaatgtcagggtcctcaagggtcccatttagacagacccacggcttgtaacagtgcgctcctcaggaggcagcactagcgcatacccactccccacggacactgagttcctggtgacagctgcagccccagccccgccaggagtcctggagacagcagccctcagagaccctgcaggagtgagtgcaccccaccttgctcagccacaccccactcccctgtgccctgtagttgtgctgcccatgctccacacaccatggggcccctttgctcatttttggactatttatacagcaggtttggatcatgtttttctactaataagaatgctaacattgttgtgtagataatcagtgagggctttatgaagtttacacctttgcattattaaaggaaataacagttcatgtgaa

SEQ ID NO: 122 - DNA, 5897 bp, Homo sapiens
actcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaaggcttcgtggactcgaccagagaagcaagaggtacatgcaccatggaactggcaagtgggcagacagaaaggacaggctggcagtgcaggtttcccaggatctcatgagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttcttttacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattgaaagaaaaaagcta

SEQ ID NO: 123 - DNA, 4646 bp, Homo sapiens
actcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttaggaacttgaacacaaaaattaaatttgcttaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctctttctttaaatgctatttttaaaaaccatcatgctagatttacagagaagtttctgcatatctgctacttgttgcattttgggttcaaacctaaatatgatgtagcagaggaagaattctaagtaccttctaaagcttgtgtcagattgttaaaatcaccacacattcccctcattctaactctgtgctccttgtcctcccttcaataataattggctttgcttgcaattaagcatttaagtgcccatgttaaaagagccagaccgcactgattcacatgagcgttttgctgacatgatgggcaactgaagtcacccctgttgcccatgcactggaaaaaaagttgaatttgttggatattttctggggctgatgaacgttctgggatgtgctttcagtcctcgtattacggccagcaccttacactgtctctgtgaacggggccaagccatgatgtgccaacaagtgtcagctttgaaaggtgtttgtctcccaatcggggtgactcccctgctgcctggcagcatgtcgcagatcagcacagagtggggccgtggttcagcagtgacccacagaatggctttgagcatcagtctacaggacaggttggaagcatccactgtgaaccaggcattagtcccctacctggcctgtgtgtgctcagtagagaaggagagggacaggccactcccagactgcccagcccaggagggttaataaattggggccgagccaacctgtcagtgcttcctgaatgccccagcctctgtattggtgcgttggttcagtgacattttctaaactctcctgaaaatccagctgctcctccctgctgcttgggagttcacccaggagaggaaatgggtgtgttttgttaaggtcccttgtggagactcagggctgaatcctgcttggtaatatcagtgtgtgtgcttggggatggaccttctactgaataaaaactccctccctccccccattgtggtcacatatcattctacatatctcatctctgagcatctccatggaagcttgatttttgttctttttggtttctttatgtatttttttctgttgttattattttttaatgttcaaagactagcctttccctttgggattccaaatgatcccatgctgtggtctgaggggcaaagccacctatgttggcgctcgccattaatccccagcgctcagtttagaggctcacgtgcagacatcagaggctccatgctgcacagtagctcaggcagggtagtgcctctcaacccagccacaaaactctccccgctggagtcccagatggcgcttcacaccagggcagtggaggcaggcatggtttttgggcacagggcagagcataaggatcccaggtcagtgtgggagagctactggctcttaggatcaccttgggcagaagtcacacggcttcatcctaggagggcccagcttgggagtctgcctccccctgatcccaggaccacccacaggagaggggcagtgtccatctttctgaagggaccctttggagatctcgtcctaagtgtggagaggactgacgtggccctgtcatctcaacacatcccagggtcaggcaggcctcagctgaaacaatgtcagggtcctcaagggtcccatttagacagacccacggcttgtaacagtgcgctcctcaggaggcagcactagcgcatacccactccccacggacactgagttcctggtgacagctgcagccccagccccgccaggagtcctggagacagcagccctcagagaccctgcaggagtgagtgcaccccaccttgctcagccacaccccactcccctgtgccctgtagttgtgctgcccatgctccacacaccatggggcccctttgctcatttttggactatttatacagcaggtttggatcatgtttttctactaataagaatgctaacattgttgtgtagataatcagtgagggctttatgaagtttacacctttgcattattaaaggaaataacagttcatgtgaa

SEQ ID NO: 124 - DNA, 4673 bp, Homo sapiens
actcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaaggcttcgtggactcgaccagagaagcaagagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccgggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttaggaacttgaacacaaaaattaaatttgcttaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctctttctttaaatgctatttttaaaaaccatcatgctagatttacagagaagtttctgcatatctgctacttgttgcattttgggttcaaacctaaatatgatgtagcagaggaagaattctaagtaccttctaaagcttgtgtcagattgttaaaatcaccacacattcccctcattctaactctgtgctccttgtcctcccttcaataataattggctttgcttgcaattaagcatttaagtgcccatgttaaaagagccagaccgcactgattcacatgagcgttttgctgacatgatgggcaactgaagtcacccctgttgcccatgcactggaaaaaaagttgaatttgttggatattttctggggctgatgaacgttctgggatgtgctttcagtcctcgtattacggccagcaccttacactgtctctgtgaacggggccaagccatgatgtgccaacaagtgtcagctttgaaaggtgtttgtctcccaatcggggtgactcccctgctgcctggcagcatgtcgcagatcagcacagagtggggccgtggttcagcagtgacccacagaatggctttgagcatcagtctacaggacaggttggaagcatccactgtgaaccaggcattagtcccctacctggcctgtgtgtgctcagtagagaaggagagggacaggccactcccagactgcccagcccaggagggttaataaattggggccgagccaacctgtcagtgcttcctgaatgccccagcctctgtattggtgcgttggttcagtgacattttctaaactctcctgaaaatccagctgctcctccctgctgcttgggagttcacccaggagaggaaatgggtgtgttttgttaaggtcccttgtggagactcagggctgaatcctgcttggtaatatcagtgtgtgtgcttggggatggaccttctactgaataaaaactccctccctccccccattgtggtcacatatcattctacatatctcatctctgagcatctccatggaagcttgatttttgttctttttggtttctttatgtatttttttctgttgttattattttttaatgttcaaagactagcctttccctttgggattccaaatgatcccatgctgtggtctgaggggcaaagccacctatgttggcgctcgccattaatccccagcgctcagtttagaggctcacgtgcagacatcagaggctccatgctgcacagtagctcaggcagggtagtgcctctcaacccagccacaaaactctccccgctggagtcccagatggcgcttcacaccagggcagtggaggcaggcatggtttttgggcacagggcagagcataaggatcccaggtcagtgtgggagagctactggctcttaggatcaccttgggcagaagtcacacggcttcatcctaggagggcccagcttgggagtctgcctccccctgatcccaggaccacccacaggagaggggcagtgtccatctttctgaagggaccctttggagatctcgtcctaagtgtggagaggactgacgtggccctgtcatctcaacacatcccagggtcaggcaggcctcagctgaaacaatgtcagggtcctcaagggtcccatttagacagacccacggcttgtaacagtgcgctcctcaggaggcagcactagcgcatacccactccccacggacactgagttcctggtgacagctgcagccccagccccgccaggagtcctggagacagcagccctcagagaccctgcaggagtgagtgcaccccaccttgctcagccacaccccactcccctgtgccctgtagttgtgctgcccatgctccacacaccatggggcccctttgctcatttttggactatttatacagcaggtttggatcatgtttttctactaataagaatgctaacattgttgtgtagataatcagtgagggctttatgaagtttacacctttgcattattaaaggaaataacagttcatgtgaa

SEQ ID NO: 125 - DNA, 5816 bp, Homo sapiens
actcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaaggcttcgtggactcgaccagagaagcaagagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccgggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttcttttacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattgaaagaaaaaagcta

SEQ ID NO: 126 - DNA, 4643 bp, Homo sapiens
actcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccgggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttaggaacttgaacacaaaaattaaatttgcttaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctctttctttaaatgctatttttaaaaaccatcatgctagatttacagagaagtttctgcatatctgctacttgttgcattttgggttcaaacctaaatatgatgtagcagaggaagaattctaagtaccttctaaagcttgtgtcagattgttaaaatcaccacacattcccctcattctaactctgtgctccttgtcctcccttcaataataattggctttgcttgcaattaagcatttaagtgcccatgttaaaagagccagaccgcactgattcacatgagcgttttgctgacatgatgggcaactgaagtcacccctgttgcccatgcactggaaaaaaagttgaatttgttggatattttctggggctgatgaacgttctgggatgtgctttcagtcctcgtattacggccagcaccttacactgtctctgtgaacggggccaagccatgatgtgccaacaagtgtcagctttgaaaggtgtttgtctcccaatcggggtgactcccctgctgcctggcagcatgtcgcagatcagcacagagtggggccgtggttcagcagtgacccacagaatggctttgagcatcagtctacaggacaggttggaagcatccactgtgaaccaggcattagtcccctacctggcctgtgtgtgctcagtagagaaggagagggacaggccactcccagactgcccagcccaggagggttaataaattggggccgagccaacctgtcagtgcttcctgaatgccccagcctctgtattggtgcgttggttcagtgacattttctaaactctcctgaaaatccagctgctcctccctgctgcttgggagttcacccaggagaggaaatgggtgtgttttgttaaggtcccttgtggagactcagggctgaatcctgcttggtaatatcagtgtgtgtgcttggggatggaccttctactgaataaaaactccctccctccccccattgtggtcacatatcattctacatatctcatctctgagcatctccatggaagcttgatttttgttctttttggtttctttatgtatttttttctgttgttattattttttaatgttcaaagactagcctttccctttgggattccaaatgatcccatgctgtggtctgaggggcaaagccacctatgttggcgctcgccattaatccccagcgctcagtttagaggctcacgtgcagacatcagaggctccatgctgcacagtagctcaggcagggtagtgcctctcaacccagccacaaaactctccccgctggagtcccagatggcgcttcacaccagggcagtggaggcaggcatggtttttgggcacagggcagagcataaggatcccaggtcagtgtgggagagctactggctcttaggatcaccttgggcagaagtcacacggcttcatcctaggagggcccagcttgggagtctgcctccccctgatcccaggaccacccacaggagaggggcagtgtccatctttctgaagggaccctttggagatctcgtcctaagtgtggagaggactgacgtggccctgtcatctcaacacatcccagggtcaggcaggcctcagctgaaacaatgtcagggtcctcaagggtcccatttagacagacccacggcttgtaacagtgcgctcctcaggaggcagcactagcgcatacccactccccacggacactgagttcctggtgacagctgcagccccagccccgccaggagtcctggagacagcagccctcagagaccctgcaggagtgagtgcaccccaccttgctcagccacaccccactcccctgtgccctgtagttgtgctgcccatgctccacacaccatggggcccctttgctcatttttggactatttatacagcaggtttggatcatgtttttctactaataagaatgctaacattgttgtgtagataatcagtgagggctttatgaagtttacacctttgcattattaaaggaaataacagttcatgtgaa

SEQ ID NO: 127 - DNA, 5786 bp, Homo sapiens
actcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccgggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttcttttacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattgaaagaaaaaagcta

SEQ ID NO: 128 - DNA, 5819 bp, Homo sapiens
actcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaaggcttcgtggactcgaccagagaagcaagagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttcttttacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattgaaagaaaaaagcta

SEQ ID NO: 129 - DNA, 3908 bp, Homo sapiens
caaaagaactttatccctgctttcattctgacatacctattatgactttgttcactaagcagaaggaattatgggaaatggaaacttgatggcatgtttttattaaggcgttatgtgtgtatcttcactgagaaattaaagaaccaagcagaattgtatgttttcctttcagtgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcctccaactggtatcttcattatcaaccccatctcgggtcagctgtcggtgacaaagcccctggatcgcgagcagatagcccggtttcatttgagggcacatgcagtagatattaatggaaatcaagtggagaaccccattgacattgtcatcaatgttattgacatgaatgacaacagacctgagttcttacaccaggtttggaatgggacagttcctgagggatcaaagcctggaacatatgtgatgaccgtaacagcaattgatgctgacgatcccaatgccctcaatgggatgttgaggtacagaatcgtgtctcaggctccaagcaccccttcacccaacatgtttacaatcaacaatgagactggtgacatcatcacagtggcagctggacttgatcgagaaaaagtgcaacagtatacgttaataattcaagctacagacatggaaggcaatcccacatatggcctttcaaacacagccacggccgtcatcacagtgacagatgtcaatgacaatcctccagagtttactgccatgacgttttatggtgaagttcctgagaacagggtagacatcatagtagctaatctaactgtgaccgataaggatcaaccccatacaccagcctggaacgcagtgtacagaatcagtggcggagatcctactggacggttcgccatccagaccgacccaaacagcaacgacgggttagtcaccgtggtcaaaccaatcgactttgaaacaaataggatgtttgtccttactgttgctgcagaaaatcaagtgccattagccaagggaattcagcacccccctcagtcaactgcaaccgtgtctgttacagttattgacgtaaatgaaaacccttattttgcccccaatcctaagatcattcgccaagaagaagggcttcatgccggtaccatgttgacaacattcactgctcaggacccagatcgatatatgcagcaaaatattagatacactaaattatctgatcctgccaattggctaaaaatagatcctgtgaatggacaaataactacaattgctgttttggaccgagaatcaccaaatgtgaaaaacaatatatataatgctactttccttgcttctgacaatggaattcctcctatgagtggaacaggaacgctgcagatctatttacttgatattaatgacaatgcccctcaagtgttacctcaagaggcagagacttgcgaaactccagaccccaattcaattaatattacagcacttgattatgacattgatccaaatgctggaccatttgcttttgatcttcctttatctccagtgactattaagagaaattggaccatcactcggcttaatggtgattttgctcagcttaatttaaagataaaatttcttgaagctggtatctatgaagttcccatcataatcacagattcgggtaatcctcccaaatcaaatatttccatcctgcgtgtgaaggtttgccagtgtgactccaacggggactgcacagatgtggacaggattgtgggtgcggggcttggcaccggtgccatcattgccatcctgctctgcatcatcatcctgcttatccttgtgctgatgtttgtggtatggatgaaacgccgggataaagaacgccaggccaaacaacttttaattgatccagaagatgatgtaagagataatattttaaaatatgatgaagaaggtggaggagaagaagaccaggactatgacttgagccagctgcagcagcctgacactgtggagcctgatgccatcaagcctgtgggaatccgacgaatggatgaaagacccatccacgccgagccccagtatccggtccgatctgcagccccacaccctggagacattggggacttcattaatgagggccttaaagcggctgacaatgaccccacagctccaccatatgactccctgttagtgtttgactatgaaggcagtggctccactgctgggtccttgagctcccttaattcctcaagtagtggtggtgagcaggactatgattacctgaacgactgggggccacggttcaagaaacttgctgacatgtatggtggaggtgatgactgaacttcagggtgaacttggtttttggacaagtacaaacaatttcaactgatattcccaaaaagcattcagaagctaggctttaactttgtagtctactagcacagtgcttgctggaggctttggcataggctgcaaaccaatttgggctcagagggaatatcagtgatccatactgtttggaaaaacactgagctcagttacacttgaattttacagtacagaagcactgggattttatgtgcctttttgtacctttttcagattggaattagttttctgtttaaggctttaatggtactgatttctgaaacgataagtaaaagacaaaatattttgtggtgggagcagtaagttaaaccatgatatgcttcaacacgcttttgttacattgcatttgcttttattaaaatacaaaattaaacaaacaaaaaaactcatggagcgattttattatcttgggggatgagaccatgagattggaaaatgtacattacttctagttttagactttagtttgtttttttttttttcactaaaatcttaaaacttactcagctggttgcaaataaagggagttttcatatcaccaatttgtagcaaaattgaattttttcataaactagaatgttagacacattttggtcttaatccatgtacacttttttatttctgtatttttccacttcactgtaaaaatagtatgtgtacataatgttttattggcatagtctatggagaagtgcagaaacttcagaacatgtgtatgtattatttggactatggattcaggttttttgcatgtttatatctttcgttatggataaagtatttacaaaacagtgacatttgattcaattgttgagctgtagttagaatactcaatttttaatttttttaatttttttattttttattttctttttggtttggggagggagaaaagttcttagcacaaatgttttacataatttgtaccaaaaaaaaaaaaaaaggaaaggaaagaaaggggtggcctgacactggtggcactactaagtgtgtgtttttttaaaaaaaaaatggaaaaaaaaaagcttttaaactggagagacttctgacaacagctttgcctctgtattgtgtaccagaatataaatgatacacctctgaccccagcgttctgaataaaatgctaattttggatctgg

SEQ ID NO: 130 - DNA, 4016 bp, Homo sapiens
gccgtttctccgcgccgctgttggtgctgccgctgcctcctcctcctccgccgccgccgccgccgccgccgcctcctccggctcttcgctcggcccctctccgcctccatgtgccggatagcgggagcgctgcggaccctgctgccgctgctggcggccctgcttcaggcgtctgtagaggcttctggtgaaatcgcattatgcaagactggatttcctgaagatgtttacagtgcagtcttatcgaaggatgtgcatgaaggacagcctcttctcaatgtgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcctccaactggtatcttcattatcaaccccatctcgggtcagctgtcggtgacaaagcccctggatcgcgagcagatagcccggtttcatttgagggcacatgcagtagatattaatggaaatcaagtggagaaccccattgacattgtcatcaatgttattgacatgaatgacaacagacctgagttcttacaccaggtttggaatgggacagttcctgagggatcaaagcctggaacatatgtgatgaccgtaacagcaattgatgctgacgatcccaatgccctcaatgggatgttgaggtacagaatcgtgtctcaggctccaagcaccccttcacccaacatgtttacaatcaacaatgagactggtgacatcatcacagtggcagctggacttgatcgagaaaaagtgcaacagtatacgttaataattcaagctacagacatggaaggcaatcccacatatggcctttcaaacacagccacggccgtcatcacagtgacagatgtcaatgacaatcctccagagtttactgccatgacgttttatggtgaagttcctgagaacagggtagacatcatagtagctaatctaactgtgaccgataaggatcaaccccatacaccagcctggaacgcagtgtacagaatcagtggcggagatcctactggacggttcgccatccagaccgacccaaacagcaacgacgggttagtcaccgtggtcaaaccaatcgactttgaaacaaataggatgtttgtccttactgttgctgcagaaaatcaagtgccattagccaagggaattcagcacccccctcagtcaactgcaaccgtgtctgttacagttattgacgtaaatgaaaacccttattttgcccccaatcctaagatcattcgccaagaagaagggcttcatgccggtaccatgttgacaacattcactgctcaggacccagatcgatatatgcagcaaaatattagatacactaaattatctgatcctgccaattggctaaaaatagatcctgtgaatggacaaataactacaattgctgttttggaccgagaatcaccaaatgtgaaaaacaatatatataatgctactttccttgcttctgacaatggaattcctcctatgagtggaacaggaacgctgcagatctatttacttgatattaatgacaatgcccctcaagtgttacctcaagaggcagagacttgcgaaactccagaccccaattcaattaatattacagcacttgattatgacattgatccaaatgctggaccatttgcttttgatcttcctttatctccagtgactattaagagaaattggaccatcactcggcttaatggtgattttgctcagcttaatttaaagataaaatttcttgaagctggtatctatgaagttcccatcataatcacagattcgggtaatcctcccaaatcaaatatttccatcctgcgtgtgaaggtttgccagtgtgactccaacggggactgcacagatgtggacaggattgtgggtgcggggcttggcaccggtgccatcattgccatcctgctctgcatcatcatcctgcttatccttgtgctgatgtttgtggtatggatgaaacgccgggataaagaacgccaggccaaacaacttttaattgatccagaagatgatgtaagagataatattttaaaatatgatgaagaaggtggaggagaagaagaccaggactatgacttgagccagctgcagcagcctgacactgtggagcctgatgccatcaagcctgtgggaatccgacgaatggatgaaagacccatccacgccgagccccagtatccggtccgatctgcagccccacaccctggagacattggggacttcattaatgagggccttaaagcggctgacaatgaccccacagctccaccatatgactccctgttagtgtttgactatgaaggcagtggctccactgctgggtccttgagctcccttaattcctcaagtagtggtggtgagcaggactatgattacctgaacgactgggggccacggttcaagaaacttgctgacatgtatggtggaggtgatgactgaacttcagggtgaacttggtttttggacaagtacaaacaatttcaactgatattcccaaaaagcattcagaagctaggctttaactttgtagtctactagcacagtgcttgctggaggctttggcataggctgcaaaccaatttgggctcagagggaatatcagtgatccatactgtttggaaaaacactgagctcagttacacttgaattttacagtacagaagcactgggattttatgtgcctttttgtacctttttcagattggaattagttttctgtttaaggctttaatggtactgatttctgaaacgataagtaaaagacaaaatattttgtggtgggagcagtaagttaaaccatgatatgcttcaacacgcttttgttacattgcatttgcttttattaaaatacaaaattaaacaaacaaaaaaactcatggagcgattttattatcttgggggatgagaccatgagattggaaaatgtacattacttctagttttagactttagtttgtttttttttttttcactaaaatcttaaaacttactcagctggttgcaaataaagggagttttcatatcaccaatttgtagcaaaattgaattttttcataaactagaatgttagacacattttggtcttaatccatgtacacttttttatttctgtatttttccacttcactgtaaaaatagtatgtgtacataatgttttattggcatagtctatggagaagtgcagaaacttcagaacatgtgtatgtattatttggactatggattcaggttttttgcatgtttatatctttcgttatggataaagtatttacaaaacagtgacatttgattcaattgttgagctgtagttagaatactcaatttttaatttttttaatttttttattttttattttctttttggtttggggagggagaaaagttcttagcacaaatgttttacataatttgtaccaaaaaaaaaaaaaaaggaaaggaaagaaaggggtggcctgacactggtggcactactaagtgtgtgtttttttaaaaaaaaaatggaaaaaaaaaagcttttaaactggagagacttctgacaacagctttgcctctgtattgtgtaccagaatataaatgatacacctctgaccccagcgttctgaataaaatgctaattttggatctgg

SEQ ID NO: 131 - DNA, 7716 bp, Homo sapiens
ggcggcgcgccgggcagcgcttcggtggcggcggcggccgcggtggcagcgaaggcggcggcggcggcggcagtggcagtggccgctgcagccccacactccgccgccaaactggaggagcgacggaagccagaccccaggaggatggaggatgaagctgtcctggacagaggggcttccttcctcaagcatgtgtgtgatgaagaagaagtagaaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagaaaggagcagggtatcacttggatctcttttgggtggccatcctcatggttatatgctccctcatggctcttccgtggtatgtagctgctacggtcatctccattgctcacatcgacagtttgaagatggagacagagacttctgcacctggagaacaaccaaagtttctaggagtgagggaacaaagagtcactggaacccttgtgtttattctgactggtctgtcagtctttatggctcccatcttgaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcacgacctcagcttcctggatgatgtcattccagaaaaggacaagaaaaagaaggaggatgagaagaaaaagaaaaagaagaagggaagtctggacagtgacaatgatgattctgactgcccatactcagaaaaagttccaagtattaaaattccaatggacatcatggaacagcaacctttcctaagcgatagcaaaccttctgacagagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagacacaatcaagacaatagtgcaccgttccttaaaaacagcatctgaggaatcccccttttgttcttaaactttcagatgtgtcctttgataaccaaattctgtcactcaagacacagacacgcacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaactttttttaaccctttaatgaacttatctgttgagtacattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccactcattgttatgttaattaagttattattctgtctccttgtaattttgattacaaaaattttattatcctgagttagctgttacttttacagtacctgatactcctaaaacttttaacttatacaaattagtcaataatgaccccaattttttcattaaaataatagtggtgaattatatgttattgtgttaaaacctcacttgccaaattctggcttcacatttgtatttagggctatccttaaaatgatgagtctatattatctagctttctattaccctaatataaactggtataagaagactttccttttttctttatgcatggaagcatcaataaattgtttaaaaaccatgtatagtaaattcagcttaacccgtgatcttcttaagttaaaggtacttttgttttataaaagctctagataaaactttcttttctgatcatgaatcaagtatctgtggtttcatgcccctctctatacctttcaaagaactcctgaagcaacttaactcatcatttcagcctctgagtagaggtaaaacctatgtgtacttctgtttatgatccatattgatatttatgacatgaacacagaatagtaccttacatttgctaaacagacagttaatatcaaatcctttcaatattctgggaacccagggaagtttttaaaaatgtcattactttcaaaggaacagaagtagttaaccaaactaacaagcaaaacctgaggtttacctagtgacaccaaattatcggtattttaactgaatttacccattgactaagaatgaaccagatttggtggtggttttgtttctatgcaaactggacacaaattacaacagtaaatttttttataagtgcttctcccttctccatgatgtgacttccggagataaaggattcaaaagataaagacaaagtacgctcagagttgttaaccagaaagtcctggctgtggttgcagaaacactgttggaagaaaagagatgactaagtcaagtgtctgccttatcaaaagagcaaaaatgcctctggttttgtgtttgggagaaaagtatcttggacgcactgttttccttgataaaagtcatcttctctactgtgtgaaatgaatacttggaattctaattgttttgtgtgccaggggcagtaatgtccctgcctcttctcccaatcaaggttgaggagtggggctggggagaggacttaactgacttaagaagtaggaaaacaaaaacctctctcctcagccttccacctccaagagaggaggaaaaacagttgtctgctgtctgtaattcagtttgcgtgtattttatgctcatgcaccaacccatacagagtaaatcttttatcaactgtatactggtgtttaatagagaatgattgtcttccgagttttttggttccttttttaactgtgttaaagtacttgaaatgtattgactgctgactatattttaaaaacaaaatgaaataatttgagttgtattacagaggttgacattgttcagggatgggacaaagccttcttcaatccttttcatactacttaatgattttggtgcaggaacctgagattttctgatttatatttcatgatatttcacatttgctcttcacagcatgagcatgaagcccagtggcaccaaatggctgggtacaatcaagtgatattttgtagcacctcactatctgaaaggccatgagttttcagatgatttcattgagcttcattgcagcctgaaattttaaaaaagttgtgtaatacgccaaccagtcaagttgtgttttggccagagatttagatatgtccaatttcctggctcatttcattgtgctctatgggtacgtataaaaagcaagaattctgtttcctaggcaaacattgcaactcagggctaaagtcatccagtgaaacttttagagccagaagtaactttgtcccagtcctacaatgtgaaaagagtgaatagttgcctctttttagccattttcatggctggtacatattcgtacgcattacttttcagaatcaatacgcactttcagatattcttatttttattctcttaagtctttattaactttggagagagaaatgatgcatctttttattttaaatgaagtagatcaacatggtggaacaaaatgataaagaacagaaaacatttcaatatattactaataactttttccaatataaatcctaaaattcctataacatagtattttacagttttatgaagctttctattgtgacttttatggaattaagagatgaagaagatgagatattttagcatttatatttttcaaaattatatgtatacttaaaaataaagtaactttatgca

SEQ ID NO: 132 - DNA, 8113 bp, Homo sapiens
ggcacagcctccgccgcggccgccttccgtgagcccccgcaccccggcttgctcccgaggggcgcctgggctgggctccactgctgcagtgttagttactagcaggaacatcagagatccccataaatatgcaggagctgcaggaggcaaagtagagtagacgcccgcgctcttacacactcgctcgccgcgcaccacacaggctgtgtagacatccccccgcgccacctttcccctttcctcgcgggccgttcaggttgcagtcctgcctgctccgaagaccctcccgccccagcgcctttgccccgctctcccgcgctcgcctctctccggagcgcgcacccacccaggcggcaaagttgtgactacttgggcgcgggtgactggcgccccgctcgctccgcgcccggcgcagacaacttcccgcggctcggccccgccgcgtcccgggctcgcgcctccagggattccgcggccccccagcctccaaccccggcggcgcgccgggcagcgcttcggtggcggcggcggccgcggtggcagcgaaggcggcggcggcggcggcagtggcagtggccgctgcagccccacactccgccgccaaactggaggagcgacggaagccagaccccaggaggatggaggatgaagctgtcctggacagaggggcttccttcctcaagcatgtgtgtgatgaagaagaagtagaaggccaccataccatttacatcggagtccatgtgccgaagagttacaggagaaggagacgtcacaagagaaagacagggcacaaagaaaagaaggaaaaggagagaatctctgagaactactctgacaaatcagatattgaaaatgctgatgaatccagcagcagcatcctaaaacctctcatctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagaaaggagcagggtatcacttggatctcttttgggtggccatcctcatggttatatgctccctcatggctcttccgtggtatgtagctgctacggtcatctccattgctcacatcgacagtttgaagatggagacagagacttctgcacctggagaacaaccaaagtttctaggagtgagggaacaaagagtcactggaacccttgtgtttattctgactggtctgtcagtctttatggctcccatcttgaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcacgacctcagcttcctggatgatgtcattccagaaaaggacaagaaaaagaaggaggatgagaagaaaaagaaaaagaagaagggaagtctggacagtgacaatgatgatgagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagacacaatcaagacaatagtgcaccgttccttaaaaacagcatctgaggaatcccccttttgttcttaaactttcagatgtgtcctttgataaccaaattctgtcactcaagacacagacacgcacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaactttttttaaccctttaatgaacttatctgttgagtacattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccactcattgttatgttaattaagttattattctgtctccttgtaattttgattacaaaaattttattatcctgagttagctgttacttttacagtacctgatactcctaaaacttttaacttatacaaattagtcaataatgaccccaattttttcattaaaataatagtggtgaattatatgttattgtgttaaaacctcacttgccaaattctggcttcacatttgtatttagggctatccttaaaatgatgagtctatattatctagctttctattaccctaatataaactggtataagaagactttccttttttctttatgcatggaagcatcaataaattgtttaaaaaccatgtatagtaaattcagcttaacccgtgatcttcttaagttaaaggtacttttgttttataaaagctctagataaaactttcttttctgatcatgaatcaagtatctgtggtttcatgcccctctctatacctttcaaagaactcctgaagcaacttaactcatcatttcagcctctgagtagaggtaaaacctatgtgtacttctgtttatgatccatattgatatttatgacatgaacacagaatagtaccttacatttgctaaacagacagttaatatcaaatcctttcaatattctgggaacccagggaagtttttaaaaatgtcattactttcaaaggaacagaagtagttaaccaaactaacaagcaaaacctgaggtttacctagtgacaccaaattatcggtattttaactgaatttacccattgactaagaatgaaccagatttggtggtggttttgtttctatgcaaactggacacaaattacaacagtaaatttttttataagtgcttctcccttctccatgatgtgacttccggagataaaggattcaaaagataaagacaaagtacgctcagagttgttaaccagaaagtcctggctgtggttgcagaaacactgttggaagaaaagagatgactaagtcaagtgtctgccttatcaaaagagcaaaaatgcctctggttttgtgtttgggagaaaagtatcttggacgcactgttttccttgataaaagtcatcttctctactgtgtgaaatgaatacttggaattctaattgttttgtgtgccaggggcagtaatgtccctgcctcttctcccaatcaaggttgaggagtggggctggggagaggacttaactgacttaagaagtaggaaaacaaaaacctctctcctcagccttccacctccaagagaggaggaaaaacagttgtctgctgtctgtaattcagtttgcgtgtattttatgctcatgcaccaacccatacagagtaaatcttttatcaactgtatactggtgtttaatagagaatgattgtcttccgagttttttggttccttttttaactgtgttaaagtacttgaaatgtattgactgctgactatattttaaaaacaaaatgaaataatttgagttgtattacagaggttgacattgttcagggatgggacaaagccttcttcaatccttttcatactacttaatgattttggtgcaggaacctgagattttctgatttatatttcatgatatttcacatttgctcttcacagcatgagcatgaagcccagtggcaccaaatggctgggtacaatcaagtgatattttgtagcacctcactatctgaaaggccatgagttttcagatgatttcattgagcttcattgcagcctgaaattttaaaaaagttgtgtaatacgccaaccagtcaagttgtgttttggccagagatttagatatgtccaatttcctggctcatttcattgtgctctatgggtacgtataaaaagcaagaattctgtttcctaggcaaacattgcaactcagggctaaagtcatccagtgaaacttttagagccagaagtaactttgtcccagtcctacaatgtgaaaagagtgaatagttgcctctttttagccattttcatggctggtacatattcgtacgcattacttttcagaatcaatacgcactttcagatattcttatttttattctcttaagtctttattaactttggagagagaaatgatgcatctttttattttaaatgaagtagatcaacatggtggaacaaaatgataaagaacagaaaacatttcaatatattactaataactttttccaatataaatcctaaaattcctataacatagtattttacagttttatgaagctttctattgtgacttttatggaattaagagatgaagaagatgagatattttagcatttatatttttcaaaattatatgtatacttaaaaataaagtaactttatgca

SEQ ID NO: 133 - DNA, 7669 bp, Homo sapiens
gtcttataattttggatgagtcataagtggagaaggaggggaagtgagtggttagacctcagctcatctgagggctaaaggttctttgtgacacatcacacagaattggagtgctgtccttctggagagtggtggagaaccaagatacagttcagaaccaaaggaatagagaagggctttgatttctttttggctttagattggggatttgggaggcttagcaggaaagatgtccactgaaaatgtggaagggaagcccagtaaccttggggagagaggaagagcccggagctccactttcctcagggttgtccagccaatgtttaaccacagtattttcacttctgcagtctctcctgctgcagaacgcatccgattcatcttgggagaggaggatgacagcccagctccccctcagctcttcacggaactggatgagctgctggccgtggatgggcaggagatggagtggaaggaaacagccaggtggatcaagtttgaagaaaaagtggaacagggtggggaaagatggagcaagccccatgtggccacattgtcccttcatagtttatttgagctgaggacatgtatggagaaaggatccatcatgcttgatcgggaggcttcttctctcccacagttggtggagatgattgttgaccatcagattgagacaggcctattgaaacctgaacttaaggataaggtgacctatactttgctccggaagcaccggcatcaaaccaagaaatccaaccttcggtccctggctgacattgggaagacagtctccagtgcaagtaggatgtttaccaaccctgataatggtagcccagccatgacccataggaatctgacttcctccagtctgaatgacatttctgataaaccggagaaggaccagctgaagaataagttcatgaaaaaattgccacgtgatgcagaagcttccaacgtgcttgttggggaggttgactttttggatactcctttcattgcctttgttaggctacagcaggctgtcatgctgggtgccctgactgaagttcctgtgcccacaaggttcttgttcattctcttaggtcctaaggggaaagccaagtcctaccacgagattggcagagccattgccaccctgatgtctgatgaggtgttccatgacattgcttataaagcaaaagacaggcacgacctgattgctggtattgatgagttcctagatgaagtcatcgtccttccacctggggaatgggatccagcaattaggatagagcctcctaagagtcttccatcctctgacaaaagaaagaatatgtactcaggtggagagaatgttcagatgaatggggatacgccccatgatggaggtcacggaggaggaggacatggggattgtgaagaattgcagcgaactggacggttctgtggtggactaattaaagacataaagaggaaagcgccattttttgccagtgatttttatgatgctttaaatattcaagctctttcggcaattctcttcatttatctggcaactgtaactaatgctatcacttttggaggactgcttggggatgccactgacaacatgcagggcgtgttggagagtttcctgggcactgctgtctctggagccatcttttgcctttttgctggtcaaccactcactattctgagcagcaccggacctgtcctagtttttgagaggcttctatttaatttcagcaaggacaataattttgactatttggagtttcgcctttggattggcctgtggtccgccttcctatgtctcattttggtagccactgatgccagcttcttggttcaatacttcacacgtttcacggaggagggcttttcctctctgattagcttcatctttatctatgatgctttcaagaagatgatcaagcttgcagattactaccccatcaactccaacttcaaagtgggctacaacactctcttttcctgtacctgtgtgccacctgacccagctaatatctcaatatctaatgacaccacactggccccagagtatttgccaactatgtcttctactgacatgtaccataatactacctttgactgggcatttttgtcgaagaaggagtgttcaaaatacggaggaaacctcgtcgggaacaactgtaattttgttcctgatatcacactcatgtcttttatcctcttcttgggaacctacacctcttccatggctctgaaaaaattcaaaactagtccttattttccaaccacagcaagaaaactgatcagtgattttgccattatcttgtccattctcatcttttgtgtaatagatgccctagtaggcgtggacaccccaaaactaattgtgccaagtgagttcaagccaacaagtccaaaccgaggttggttcgttccaccgtttggagaaaacccctggtgggtgtgccttgctgctgctatcccggctttgttggtcactatactgattttcatggaccaacaaattacagctgtgattgtaaacaggaaagaacataaactcaagaaaggagcagggtatcacttggatctcttttgggtggccatcctcatggttatatgctccctcatggctcttccgtggtatgtagctgctacggtcatctccattgctcacatcgacagtttgaagatggagacagagacttctgcacctggagaacaaccaaagtttctaggagtgagggaacaaagagtcactggaacccttgtgtttattctgactggtctgtcagtctttatggctcccatcttgaagtttatacccatgcctgtactctatggtgtgttcctgtatatgggagtagcatcccttaatggtgtgcagttcatggatcgtctgaagctgcttctgatgcctctgaagcatcagcctgacttcatctacctgcgtcatgttcctctgcgcagagtccacctgttcactttcctgcaggtgttgtgtctggccctgctttggatcctcaagtcaacggtggctgctatcatttttccagtaatgatcttggcacttgtagctgtcagaaaaggcatggactacctcttctcccagcacgacctcagcttcctggatgatgtcattccagaaaaggacaagaaaaagaaggaggatgagaagaaaaagaaaaagaagaagggaagtctggacagtgacaatgatgattctgactgcccatactcagaaaaagttccaagtattaaaattccaatggacatcatggaacagcaacctttcctaagcgatagcaaaccttctgacagagaaagatcaccaacattccttgaacgccacacatcatgctgataaaattcctttccttcagtcactcggtatgccaagtcctcctagaactccagtaaaagttgtgcctcaaattagaatagaacttgaacctgaagacaatgattatttctggaggagcaagggaacagaaactacattgtaacctgtttgtctttcttaaaactgacatttgttgttaatgtcatttgtttttgtttggctgtttgtttattttttaacttttatttcgtctcagtttttggtcacaggccaaataatacagcgctctctctgcttctctcttgcatagacacaatcaagacaatagtgcaccgttccttaaaaacagcatctgaggaatcccccttttgttcttaaactttcagatgtgtcctttgataaccaaattctgtcactcaagacacagacacgcacagaccctgtcctttgcctctattaagcagaggatggaagtattaaggattttgtaacaccttttatgaaaatgttgaaggaacttaaaactttagctttggagctgtgcttactggcttgtctttgtctggtagaacaaaccttgacctccagacagagtcccttctcacttatagagctctccaggactggaaaaagtgctgctattttaacttgctcttgcttgtaaatcctaatcttagagttatcaaaagaagaaaaaactgaaggtactttactccctatagagaaaccattgccatcattgtagcaagtgctggaatgtcccttttttcctatgcaactttttttaaccctttaatgaacttatctgttgagtacattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaactataaccagttgttgaggggtatactagaagcagaatgaaaccacattttttggtttgataatatgcacttattgactcccactcattgttatgttaattaagttattattctgtctccttgtaattttgattacaaaaattttattatcctgagttagctgttacttttacagtacctgatactcctaaaacttttaacttatacaaattagtcaataatgaccccaattttttcattaaaataatagtggtgaattatatgttattgtgttaaaacctcacttgccaaattctggcttcacatttgtatttagggctatccttaaaatgatgagtctatattatctagctttctattaccctaatataaactggtataagaagactttccttttttctttatgcatggaagcatcaataaattgtttaaaaaccatgtatagtaaattcagcttaacccgtgatcttcttaagttaaaggtacttttgttttataaaagctctagataaaactttcttttctgatcatgaatcaagtatctgtggtttcatgcccctctctatacctttcaaagaactcctgaagcaacttaactcatcatttcagcctctgagtagaggtaaaacctatgtgtacttctgtttatgatccatattgatatttatgacatgaacacagaatagtaccttacatttgctaaacagacagttaatatcaaatcctttcaatattctgggaacccagggaagtttttaaaaatgtcattactttcaaaggaacagaagtagttaaccaaactaacaagcaaaacctgaggtttacctagtgacaccaaattatcggtattttaactgaatttacccattgactaagaatgaaccagatttggtggtggttttgtttctatgcaaactggacacaaattacaacagtaaatttttttataagtgcttctcccttctccatgatgtgacttccggagataaaggattcaaaagataaagacaaagtacgctcagagttgttaaccagaaagtcctggctgtggttgcagaaacactgttggaagaaaagagatgactaagtcaagtgtctgccttatcaaaagagcaaaaatgcctctggttttgtgtttgggagaaaagtatcttggacgcactgttttccttgataaaagtcatcttctctactgtgtgaaatgaatacttggaattctaattgttttgtgtgccaggggcagtaatgtccctgcctcttctcccaatcaaggttgaggagtggggctggggagaggacttaactgacttaagaagtaggaaaacaaaaacctctctcctcagccttccacctccaagagaggaggaaaaacagttgtctgctgtctgtaattcagtttgcgtgtattttatgctcatgcaccaacccatacagagtaaatcttttatcaactgtatactggtgtttaatagagaatgattgtcttccgagttttttggttccttttttaactgtgttaaagtacttgaaatgtattgactgctgactatattttaaaaacaaaatgaaataatttgagttgtattacagaggttgacattgttcagggatgggacaaagccttcttcaatccttttcatactacttaatgattttggtgcaggaacctgagattttctgatttatatttcatgatatttcacatttgctcttcacagcatgagcatgaagcccagtggcaccaaatggctgggtacaatcaagtgatattttgtagcacctcactatctgaaaggccatgagttttcagatgatttcattgagcttcattgcagcctgaaattttaaaaaagttgtgtaatacgccaaccagtcaagttgtgttttggccagagatttagatatgtccaatttcctggctcatttcattgtgctctatgggtacgtataaaaagcaagaattctgtttcctaggcaaacattgcaactcagggctaaagtcatccagtgaaacttttagagccagaagtaactttgtcccagtcctacaatgtgaaaagagtgaatagttgcctctttttagccattttcatggctggtacatattcgtacgcattacttttcagaatcaatacgcactttcagatattcttatttttattctcttaagtctttattaactttggagagagaaatgatgcatctttttattttaaatgaagtagatcaacatggtggaacaaaatgataaagaacagaaaacatttcaatatattactaataactttttccaatataaatcctaaaattcctataacatagtattttacagttttatgaagctttctattgtgacttttatggaattaagagatgaagaagatgagatattttagcatttatatttttcaaaattatatgtatacttaaaaataaagtaactttatgca

SEQ ID NO: 134 - DNA, 4662 bp, Homo sapiens
agagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagctatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctaatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttca

SEQ ID NO: 135 - DNA, 2750 bp, Homo sapiens
agagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagctatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagtgagttgtggaaaaaagatcttcatcgttcattgactttcactgggagaaaatacaatgtgctaattttgctcactccagtcgtgcatataatttatacaataaggaagatgtatccccaaatcaggttgattatatattttgtttcaactaattttgactacactgcctttgtcagggacatggcttgggatactgtttcacatgtgtccgtttatttgtctcaatcaatagcctgaattcaattatttgattttttcagtgcttgagtgaattttttaaagcgtatacttcctaaaggtcaacaaccatagactttttggttgaagttggagaagattcattaaaagtacctagtacatcttgtagggactgccaggtgtctttgcagtgacacatctggccagcaatgaaactgctgctgaggtaggaatatcttattgttattactcccatattctagttagttgactttgatccatataagagtctatatcagagaaaatcatgtcattatgtcaacttgagtttttaaaaatggattaaagtaccaacactacattaaaaatgctttagagatgttaaa

SEQ ID NO: 136 - DNA, 1773 bp, Homo sapiens
agagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcagtaagtagtctgcagcagtgtcactgctaagtgggattgatggccagtaccagaccatgttctttagaaagaagactgaactctctgtagtgtctctatagcaggtatctatataaggggacttaaagagatcttcattctgctcatatatactatcagcaaagaaaacaaagagtatgaaattcaaataggagatttgcagtgaggaactaaaataatattctctgttactttgtcatgtaaaaatgtcgtgagctatgaagtactactactgataactagcaggtgatcttaatttttactgacatgtacaaataagtgttgtgtgatacatacatagatatatgatatatatgtaatcatgtatatcacgcatacatatacatgtatttggctgaaccaaatgaaattgccattttgctgcataataaaaaaatataagcaaattcaaactatattttaacagaggtataaattttccatttatatatatccacatatataaatatcccatatatatccacatacaaatattttatatattatatatattagagatatagatacatttccatcctgacctttattgactggttattgatttagatttcaaaaagtattcacttgctttagaaaattgtcctaaaattaaaaaaactcactataccctgaatgcttatgtgggatacaccaaggggagaaagtagagtagtgatggaagaagagaaaattgtagaagaaacttggaataattatagtcactatgacaaaattactttgcctaatgatagcatatagttaatgttactgtgcaaataactgtgcaaatgaatgacttgagaagttataattaaagtatttcatcttttaaaactcaaa

SEQ ID NO: 137 - DNA, 4701 bp, Homo sapiens
agagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgacggatgtgaggcgcaatgcaacaggagactacaagtgttccctgatagacaaaaaaagcatgattgcttcaacagctatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttca

SEQ ID NO: 138 - DNA, 2551 bp, Homo sapiens
agtccgggggcatcgcgatgctgctgcgcctgttgctggcctgggcggccgcagggcccacactgggccaggacccctgggctgctgagccccgtgccgcctgcggccccagcagctgctacgctctcttcccacggcgccgcaccttcctggaggcctggcgggcctgccgcgagctggggggcgacctggccactcctcggacccccgaggaggcccagcgtgtggacagcctggtgggtgcgggcccagccagccggctgctgtggatcgggctgcagcggcaggcccggcaatgccagctgcagcgcccactgcgcggcttcacgtggaccacaggggaccaggacacggctttcaccaactgggcccagccagcctctggaggcccctgcccggcccagcgctgtgtggccctggaggcaagtggcgagcaccgctggctggagggctcgtgcacgctggctgtcgacggctacctgtgccagtttggcttcgagggcgcctgcccggcgctgcaagatgaggcgggccaggccggcccagccgtgtataccacgcccttccacctggtctccacagagtttgagtggctgcccttcggctctgtggccgctgtgcagtgccaggctggcaggggagcctctctgctctgcgtgaagcagcctgagggaggtgtgggctggtcacgggctgggcccctgtgcctggggactggctgcagccctgacaacgggggctgcgaacacgaatgtgtggaggaggtggatggtcacgtgtcctgccgctgcactgagggcttccggctggcagcagacgggcgcagttgcgaggacccctgtgcccaggctccgtgcgagcagcagtgtgagcccggtgggccacaaggctacagctgccactgtcgcctgggtttccggccagcggaggatgatccgcaccgctgtgtggacacagatgagtgccagattgccggtgtgtgccagcagatgtgtgtcaactacgttggtggcttcgagtgttattgtagcgagggacatgagctggaggctgatggcatcagctgcagccctgcaggggccatgggtgcccaggcttcccaggacctcggagatgagttgctggatgacggggaggatgaggaagatgaagacgaggcctggaaggccttcaacggtggctggacggagatgcctgggatcctgtggatggagcctacgcagccgcctgactttgccctggcctatagaccgagcttcccagaggacagagagccacagataccctacccggagcccacctggccacccccgctcagtgcccccagggtcccctaccactcctcagtgctctccgtcacccggcctgtggtggtctctgccacgcatcccacactgccttctgcccaccagcctcctgtgatccctgccacacacccagctttgtcccgtgaccaccagatccccgtgatcgcagccaactatccagatctgccttctgcctaccaacccggtattctctctgtctctcattcagcacagcctcctgcccaccagccccctatgatctcaaccaaatatccggagctcttccctgcccaccagtcccccatgtttccagacacccgggtcgctggcacccagaccaccactcatttgcctggaatcccacctaaccatgcccctctggtcaccaccctcggtgcccagctaccccctcaagccccagatgcccttgtcctcagaacccaggccacccagcttcccattatcccaactgcccagccctctctgaccaccacctccaggtcccctgtgtctcctgcccatcaaatctctgtgcctgctgccacccagcccgcagccctccccaccctcctgccctctcagagccccactaaccagacctcacccatcagccctacacatccccattccaaagccccccaaatcccaagggaagatggccccagtcccaagttggccctgtggctgccctcaccagctcccacagcagccccaacagccctgggggaggctggtcttgccgagcacagccagagggatgaccggtggctgctggtggcactcctggtgccaacgtgtgtctttttggtggtcctgcttgcactgggcatcgtgtactgcacccgctgtggcccccatgcacccaacaagcgcatcactgactgctatcgctgggtcatccatgctgggagcaagagcccaacagaacccatgccccccaggggcagcctcacaggggtgcagacctgcagaaccagcgtgtgatggggtgcagacccccctcatggagtatggggcgctggacacatggccggggctgcaccagggacccatgggggctgcccagctggacagatggcttcctgctccccaggcccagccagggtcctctctcaaccactagacttggctctcaggaactctgcttcctggcccagcgctcgtgaccaaggatacaccaaagcccttaagacctcagggggcgggtgctggggtcttctccaataaatggggtgtcaacctta

SEQ ID NO: 139 - DNA, 1480 bp, Homo sapiens
agcatcttcgtaagcctggattgctcaccagctttcatttcagctcctgtaggcatctcctgaattaagcaacacagaaaagtcctctgaagtcactgaatcccataaaggctctctacctttagcacaagggaggtcttcaccactggacaaagaaggaacgataaggggtcatcagactggggtttctgagcatggattcaaccatcccagtcttgggtacagaactgacaccaatcaacggacgtgaggagactccttgctacaagcagaccctgagcttcacggggctgacgtgcatcgtttcccttgtcgcgctgacaggaaacgcggttgtgctctggctcctgggctgccgcatgcgcaggaacgctgtctccatctacatcctcaacctggtcgcggccgacttcctcttccttagcggccacattatatgttcgccgttacgcctcatcaatatccgccatcccatctccaaaatcctcagtcctgtgatgacctttccctactttataggcctaagcatgctgagcgccatcagcaccgagcgctgcctgtccatcctgtggcccatctggtaccactgccgccgccccagatacctgtcatcagtcatgtgtgtcctgctctgggccctgtccctgctgcggagtatcctggagtggatgttctgtgacttcctgtttagtggtgctaattctgtttggtgtgaaacgtcagatttcattacaatcgcgtggctggtttttttatgtgtggttctctgtgggtccagcctggtcctgctggtcaggattctctgtggatcccggaagatgccgctgaccaggctgtacgtgaccatcctcctcacagtgctggtcttcctcctctgtggcctgccctttggcattcagtgggccctgttttccaggatccacctggattggaaagtcttattttgtcatgtgcatctagtttccattttcctgtccgctcttaacagcagtgccaaccccatcatttacttcttcgtgggctcctttaggcagcgtcaaaataggcagaacctgaagctggttctccagagggctctgcaggacacgcctgaggtggatgaaggtggagggtggcttcctcaggaaaccctggagctgtcgggaagcagattggagcagtgaggaagaacctctgccctgtcagacaggactttgagagcaatgctgccctgccacccttgacaattatatgcatttttcttagccttctgcctcagaaatgtctcagtggtccctcaaggtcttcgaatagatgtttatctaacctgacagttgcagttttcacccatggaaagcattagtctgacagtacaatgtttggattctccttgatattaccaatacattttccctgttatcttgcactgaatctttcctactgaacactttttctgcacttttcattgtaataaaaggagttgctgtccacaaccctaaaa

SEQ ID NO: 140 - DNA, 1647 bp, Homo sapiens
gcccagtctggaaagtgaggagcgtctttgcccggccgccatcccatctaggaagtgaggagcgcctcttcccggccgccatcccatctaggaagtgaggagcgtctctgcccggccgcccatcgtctgagatgtggggagtgcctttgccccgccgccccgtctgggatgtgaggagcgcctctgcccggtcgcgaccccgtctgggagctcctgtaggcatctcctgaattaagcaacacagaaaagtcctctgaagtcactgaatcccataaaggctctctacctttagcacaagggaggtcttcaccactggacaaagaaggaacgataaggggtcatcagactggggtttctgagcatggattcaaccatcccagtcttgggtacagaactgacaccaatcaacggacgtgaggagactccttgctacaagcagaccctgagcttcacggggctgacgtgcatcgtttcccttgtcgcgctgacaggaaacgcggttgtgctctggctcctgggctgccgcatgcgcaggaacgctgtctccatctacatcctcaacctggtcgcggccgacttcctcttccttagcggccacattatatgttcgccgttacgcctcatcaatatccgccatcccatctccaaaatcctcagtcctgtgatgacctttccctactttataggcctaagcatgctgagcgccatcagcaccgagcgctgcctgtccatcctgtggcccatctggtaccactgccgccgccccagatacctgtcatcagtcatgtgtgtcctgctctgggccctgtccctgctgcggagtatcctggagtggatgttctgtgacttcctgtttagtggtgctaattctgtttggtgtgaaacgtcagatttcattacaatcgcgtggctggtttttttatgtgtggttctctgtgggtccagcctggtcctgctggtcaggattctctgtggatcccggaagatgccgctgaccaggctgtacgtgaccatcctcctcacagtgctggtcttcctcctctgtggcctgccctttggcattcagtgggccctgttttccaggatccacctggattggaaagtcttattttgtcatgtgcatctagtttccattttcctgtccgctcttaacagcagtgccaaccccatcatttacttcttcgtgggctcctttaggcagcgtcaaaataggcagaacctgaagctggttctccagagggctctgcaggacacgcctgaggtggatgaaggtggagggtggcttcctcaggaaaccctggagctgtcgggaagcagattggagcagtgaggaagaacctctgccctgtcagacaggactttgagagcaatgctgccctgccacccttgacaattatatgcatttttcttagccttctgcctcagaaatgtctcagtggtccctcaaggtcttcgaatagatgtttatctaacctgacagttgcagttttcacccatggaaagcattagtctgacagtacaatgtttggattctccttgatattaccaatacattttccctgttatcttgcactgaatctttcctactgaacactttttctgcacttttcattgtaataaaaggagttgctgtccacaaccctaaaa

SEQ ID NO: 141 - protein, 875 aa, Homo sapiens
MAAATRRVFHLQPCENSPTMSQNGYFEDSSYYKCDTDDTFEAREEILGDEAFDTANSSIVSGESIRFFVNVNLEMQATNTENEATSGGCVLLHTSRKYLKLKNFKEEIRAHRDLDGFLAQASIVLNETATSLDNVLRTMLRRFARDPDNNEPNCNLDLLMAMLFTDAGAPMRGKVHLLSDTIQGVTATVTGVRYQQSWLCIICTMKALQKRHVCISRLVRPQNWGENSCEVRFVILVLAPPKMKSTKTAMEVARTFATMFSDIAFRQKLLETRTEEEFKEALVHQRQLLTMVSHGPVAPRTKERSTVSLPAHRHPEPPKCKDFVPFGKGIREDIARRFPLYPLDFTDGIIGKNKAVGKYITTTLFLYFACLLPTIAFGSLNDENTDGAIDVQKTIAGQSIGGLLYALFSGQPLVILLTTAPLALYIQVIRVICDDYDLDFNSFYAWTGLWNSFFLALYAFFNLSLVMSLFKRSTEEIIALFISITFVLDAVKGTVKIFWKYYYGHYLDDYHTKRTSSLVSLSGLGASLNASLHTALNASFLASPTELPSATHSGQATAVLSLLIMLGTLWLGYTLYQFKKSPYLHPCVREILSDCALPIAVLAFSLISSHGFREIEMSKFRYNPSESPFAMAQIQSLSLRAVSGAMGLGFLLSMLFFIEQNLVAALVNAPENRLVKGTAYHWDLLLLAIINTGLSLFGLPWIHAAYPHSPLHVRALALVEERVENGHIYDTIVNVKETRLTSLGASVLVGLSLLLLPVPLQWIPKPVLYGLFLYIALTSLDGNQLVQRVALLLKEQTAYPPTHYIRRVPQRKIHYFTGLQVLQLLLLCAFGMSSLPYMKMIFPLIMIAMIPIRYILLPRIIEAKYLDVMDAEHRP

SEQ ID NO: 142 - protein, 891 aa, Homo sapiens
MSQVGGRGDRCTQEVQGLVHGAGDLSASLAENSPTMSQNGYFEDSSYYKCDTDDTFEAREEILGDEAFDTANSSIVSGESIRFFVNVNLEMQATNTENEATSGGCVLLHTSRKYLKLKNFKEEIRAHRDLDGFLAQASIVLNETATSLDNVLRTMLRRFARDPDNNEPNCNLDLLMAMLFTDAGAPMRGKVHLLSDTIQGVTATVTGVRYQQSWLCIICTMKALQKRHVCISRLVRPQNWGENSCEVRFVILVLAPPKMKSTKTAMEVARTFATMFSDIAFRQKLLETRTEEEFKEALVHQRQLLTMVSHGPVAPRTKERSTVSLPAHRHPEPPKCKDFVPFGKGIREDIARRFPLYPLDFTDGIIGKNKAVGKYITTTLFLYFACLLPTIAFGSLNDENTDGAIDVQKTIAGQSIGGLLYALFSGQPLVILLTTAPLALYIQVIRVICDDYDLDFNSFYAWTGLWNSFFLALYAFFNLSLVMSLFKRSTEEIIALFISITFVLDAVKGTVKIFWKYYYGHYLDDYHTKRTSSLVSLSGLGASLNASLHTALNASFLASPTELPSATHSGQATAVLSLLIMLGTLWLGYTLYQFKKSPYLHPCVREILSDCALPIAVLAFSLISSHGFREIEMSKFRYNPSESPFAMAQIQSLSLRAVSGAMGLGFLLSMLFFIEQNLVAALVNAPENRLVKGTAYHWDLLLLAIINTGLSLFGLPWIHAAYPHSPLHVRALALVEERVENGHIYDTIVNVKETRLTSLGASVLVGLSLLLLPVPLQWIPKPVLYGLFLYIALTSLDGNQLVQRVALLLKEQTAYPPTHYIRRVPQRKIHYFTGLQVLQLLLLCAFGMSSLPYMKMIFPLIMIAMIPIRYILLPRIIEAKYLDVMDAEHRP

SEQ ID NO: 143 - protein, 918 aa, Homo sapiens
MGVYGPQDRSESEKRDVQRDPPPWHPRREGERPARARSLPLAAAGQGFLRKTWISEHENSPTMSQNGYFEDSSYYKCDTDDTFEAREEILGDEAFDTANSSIVSGESIRFFVNVNLEMQATNTENEATSGGCVLLHTSRKYLKLKNFKEEIRAHRDLDGFLAQASIVLNETATSLDNVLRTMLRRFARDPDNNEPNCNLDLLMAMLFTDAGAPMRGKVHLLSDTIQGVTATVTGVRYQQSWLCIICTMKALQKRHVCISRLVRPQNWGENSCEVRFVILVLAPPKMKSTKTAMEVARTFATMFSDIAFRQKLLETRTEEEFKEALVHQRQLLTMVSHGPVAPRTKERSTVSLPAHRHPEPPKCKDFVPFGKGIREDIARRFPLYPLDFTDGIIGKNKAVGKYITTTLFLYFACLLPTIAFGSLNDENTDGAIDVQKTIAGQSIGGLLYALFSGQPLVILLTTAPLALYIQVIRVICDDYDLDFNSFYAWTGLWNSFFLALYAFFNLSLVMSLFKRSTEEIIALFISITFVLDAVKGTVKIFWKYYYGHYLDDYHTKRTSSLVSLSGLGASLNASLHTALNASFLASPTELPSATHSGQATAVLSLLIMLGTLWLGYTLYQFKKSPYLHPCVREILSDCALPIAVLAFSLISSHGFREIEMSKFRYNPSESPFAMAQIQSLSLRAVSGAMGLGFLLSMLFFIEQNLVAALVNAPENRLVKGTAYHWDLLLLAIINTGLSLFGLPWIHAAYPHSPLHVRALALVEERVENGHIYDTIVNVKETRLTSLGASVLVGLSLLLLPVPLQWIPKPVLYGLFLYIALTSLDGNQLVQRVALLLKEQTAYPPTHYIRRVPQRKIHYFTGLQVLQLLLLCAFGMSSLPYMKMIFPLIMIAMIPIRYILLPRIIEAKYLDVMDAEHRP

SEQ ID NO: 144 - protein, 837 aa, Homo sapiens
MAAATRRVFHLQPCENSPTMSQNGYFEDSSYYKCDTDDTFEAREEILGDEAFDTANSSIVSGESIRFFVNVNLEMQATNTENEATSGGCVLLHTSRKYLKLKNFKEEIRAHRDLDGFLAQASIVLNETATSLDNVLRTMLRRFARDPDNNEPNCNLDLLMAMLFTDAGAPMRGKVHLLSDTIQGVTATVTGVRYQQSWLCIICTMKALQKRHVCISRLVRPQNWGENSCEVRFVILVLAPPKMKSTKTAMEVARTFATMFSDIAFRQKLLETRTEEEFKEALVHQRQLLTMVSHGPVAPRTKERSTVSLPAHRHPEPPKCKDFVPFGKGIREDIARRFPLYPLDFTDGIIGKNKAVGKYITTTLFLYFACLLPTIAFGSLNDENTDGAIVIRVICDDYDLDFNSFYAWTGLWNSFFLALYAFFNLSLVMSLFKRSTEEIIALFISITFVLDAVKGTVKIFWKYYYGHYLDDYHTKRTSSLVSLSGLGASLNASLHTALNASFLASPTELPSATHSGQATAVLSLLIMLGTLWLGYTLYQFKKSPYLHPCVREILSDCALPIAVLAFSLISSHGFREIEMSKFRYNPSESPFAMAQIQSLSLRAVSGAMGLGFLLSMLFFIEQNLVAALVNAPENRLVKGTAYHWDLLLLAIINTGLSLFGLPWIHAAYPHSPLHVRALALVEERVENGHIYDTIVNVKETRLTSLGASVLVGLSLLLLPVPLQWIPKPVLYGLFLYIALTSLDGNQLVQRVALLLKEQTAYPPTHYIRRVPQRKIHYFTGLQVLQLLLLCAFGMSSLPYMKMIFPLIMIAMIPIRYILLPRIIEAKYLDVMDAEHRP

SEQ ID NO: 145 - protein, 744 aa, Homo sapiens
MAVLPGPLQLLGVLLTISLSSIRLIQAGAYYGIKPLPPQIPPQMPPQIPQYQPLGQQVPHMPLAKDGLAMGKEMPHLQYGKEYPHLPQYMKEIQPAPRMGKEAVPKKGKEIPLASLRGEQGPRGEPGPRGPPGPPGLPGHGIPGIKGKPGPQGYPGVGKPGMPGMPGKPGAMGMPGAKGEIGQKGEIGPMGIPGPQGPPGPHGLPGIGKPGGPGLPGQPGPKGDRGPKGLPGPQGLRGPKGDKGFGMPGAPGVKGPPGMHGPPGPVGLPGVGKPGVTGFPGPQGPLGKPGAPGEPGPQGPIGVPGVQGPPGIPGIGKPGQDGIPGQPGFPGGKGEQGLPGLPGPPGLPGIGKPGFPGPKGDRGMGGVPGALGPRGEKGPIGAPGIGGPPGEPGLPGIPGPMGPPGAIGFPGPKGEGGIVGPQGPPGPKGEPGLQGFPGKPGFLGEVGPPGMRGLPGPIGPKGEAGQKGVPGLPGVPGLLGPKGEPGIPGDQGLQGPPGIPGIGGPSGPIGPPGIPGPKGEPGLPGPPGFPGIGKPGVAGLHGPPGKPGALGPQGQPGLPGPPGPPGPPGPPAVMPPTPPPQGEYLPDMGLGIDGVKPPHAYGAKKGKNGGPAYEMPAFTAELTAPFPPVGAPVKFNKLLYNGRQNYNPQTGIFTCEVPGVYYFAYHVHCKGGNVWVALFKNNEPVMYTYDEYKKGFLDQASGSAVLLLRPGDRVFLQMPSEQAAGLYAGQYVHSSFSGYLLYPM

SEQ ID NO: 146 - protein, 322 aa, Homo sapiens
MDSTIPVLGTELTPINGREETPCYKQTLSFTGLTCIVSLVALTGNAVVLWLLGCRMRRNAVSIYILNLVAADFLFLSGHIICSPLRLINIRHPISKILSPVMTFPYFIGLSMLSAISTERCLSILWPIWYHCRRPRYLSSVMCVLLWALSLLRSILEWMFCDFLFSGANSVWCETSDFITIAWLVFLCVVLCGSSLVLLVRILCGSRKMPLTRLYVTILLTVLVFLLCGLPFGIQWALFSRIHLDWKVLFCHVHLVSIFLSALNSSANPIIYFFVGSFRQRQNRQNLKLVLQRALQDTPEVDEGGGWLPQETLELSGSRLEQ

SEQ ID NO: 147 - protein, 638 aa, Homo sapiens
MPLPLLPMDLKGEPGPPGKPGPRGPPGPPGFPGKPGMGKPGLHGQPGPAGPPGFSRMGKAGPPGLPGKVGPPGQPGLRGEPGIRGDQGLRGPPGPPGLPGPSGITIPGKPGAQGVPGPPGFQGEPGPQGEPGPPGDRGLKGDNGVGQPGLPGAPGQGGAPGPPGLPGPAGLGKPGLDGLPGAPGDKGESGPPGVPGPRGEPGAVGPKGPPGVDGVGVPGAAGLPGPQGPSGAKGEPGTRGPPGLIGPTGYGMPGLPGPKGDRGPAGVPGLLGDRGEPGEDGEPGEQGPQGLGGPPGLPGSAGLPGRRGPPGPKGEAGPGGPPGVPGIRGDQGPSGLAGKPGVPGERGLPGAHGPPGPTGPKGEPGFTGRPGGPGVAGALGQKGDLGLPGQPGLRGPSGIPGLQGPAGPIGPQGLPGLKGEPGLPGPPGEGRAGEPGTAGPTGPPGVPGSPGITGPPGPPGPPGPPGAPGAFDETGIAGLHLPNGGVEGAVLGKGGKPQFGLGELSAHATPAFTAVLTSPFPASGMPVKFDRTLYNGHSGYNPATGIFTCPVGGVYYFAYHVHVKGTNVWVALYKNNVPATYTYDEYKKGYLDQASGGAVLQLRPNDQVWVQMPSDQANGLYSTEYIHSSFSGFLLCPT

SEQ ID NO: 148 - protein, 703 aa, Homo sapiens
MLGTLTPLSSLLLLLLVLVLGCGPRASSGGGAGGAAGYAPVKYIQPMQKGPVGPPFREGKGQYLEMPLPLLPMDLKGEPGPPGKPGPRGPPGPPGFPGKPGMGKPGLHGQPGPAGPPGFSRMGKAGPPGLPGKVGPPGQPGLRGEPGIRGDQGLRGPPGPPGLPGPSGITIPGKPGAQGVPGPPGFQGEPGPQGEPGPPGDRGLKGDNGVGQPGLPGAPGQGGAPGPPGLPGPAGLGKPGLDGLPGAPGDKGESGPPGVPGPRGEPGAVGPKGPPGVDGVGVPGAAGLPGPQGPSGAKGEPGTRGPPGLIGPTGYGMPGLPGPKGDRGPAGVPGLLGDRGEPGEDGEPGEQGPQGLGGPPGLPGSAGLPGRRGPPGPKGEAGPGGPPGVPGIRGDQGPSGLAGKPGVPGERGLPGAHGPPGPTGPKGEPGFTGRPGGPGVAGALGQKGDLGLPGQPGLRGPSGIPGLQGPAGPIGPQGLPGLKGEPGLPGPPGEGRAGEPGTAGPTGPPGVPGSPGITGPPGPPGPPGPPGAPGAFDETGIAGLHLPNGGVEGAVLGKGGKPQFGLGELSAHATPAFTAVLTSPFPASGMPVKFDRTLYNGHSGYNPATGIFTCPVGGVYYFAYHVHVKGTNVWVALYKNNVPATYTYDEYKKGYLDQASGGAVLQLRPNDQVWVQMPSDQANGLYSTEYIHSSFSGFLLCPT

SEQ ID NO: 149 - protein, 323 aa, Homo sapiens
MASEFKKKLFWRAVVAEFLATTLFVFISIGSALGFKYPVGNNQTAVQDNVKVSLAFGLSIATLAQSVGHISGAHLNPAVTLGLLLSCQISIFRALMYIIAQCVGAIVATAILSGITSSLTGNSLGRNDLADGVNSGQGLGIEIIGTLQLVLCVLATTDRRRRDLGGSAPLAIGLSVALGHLLAIDYTGCGINPARSFGSAVITHNFSNHWIFWVGPFIGGALAVLIYDFILAPRSSDLTDRVKVWTSGQVEEYDLDADDINSRSFLGTKIYQFTHSLEVVEEVKERDPPASRPSEHDGRCARKSPLAPKLLTDSPAQVPGILP

SEQ ID NO: 150 - protein, 269 aa, Homo sapiens
MASEFKKKLFWRAVVAEFLATTLFVFISIGSALGFKYPVGNNQTAVQDNVKVSLAFGLSIATLAQSVGHISGAHLNPAVTLGLLLSCQISIFRALMYIIAQCVGAIVATAILSGITSSLTGNSLGRNDLADGVNSGQGLGIEIIGTLQLVLCVLATTDRRRRDLGGSAPLAIGLSVALGHLLAIDYTGCGINPARSFGSAVITHNFSNHWIFWVGPFIGGALAVLIYDFILAPRSSDLTDRVKVWTSGQVEEYDLDADDINSRVEMKPK

SEQ ID NO: 151 - protein, 1023 aa, Homo sapiens
MGKGVGRDKYEPAAVSEQGDKKGKKGKKDRDMDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNETVEDIAARLNIPVSQVNPRDAKACVVHGSDLKDMTSEQLDDILKYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLIFIIANIPLPLGTVTILCIDLGTDMVPAISLAYEQAESDIMKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 152 - protein, 1023 aa, Homo sapiens
MAFKVGRDKYEPAAVSEQGDKKGKKGKKDRDMDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNETVEDIAARLNIPVSQVNPRDAKACVVHGSDLKDMTSEQLDDILKYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLIFIIANIPLPLGTVTILCIDLGTDMVPAISLAYEQAESDIMKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 153 - protein, 992 aa, Homo sapiens
MDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNETVEDIAARLNIPVSQVNPRDAKACVVHGSDLKDMTSEQLDDILKYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLIFIIANIPLPLGTVTILCIDLGTDMVPAISLAYEQAESDIMKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 154 - protein, 1861 aa, Homo sapiens
MRRLEGLCLRRRRRRRGPARERSGDKMKYQKYLTVLQMAIGVTPSNRGSLLPLKRKLWVTPSSENPNGATSSVSQGKPSLRRIKGRLHRSKSLDSMDFCELTSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRVVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQKAEASSPVPYLSPETNPASSTSAVNHNVNLTNVRLEEPTPAPSTSYSPQADSLRTPSTEAAHIMLRDQEPSLSSHVDPTKVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCASMTPDGWSFALKSSDSSSGDPKTWQNKCLPGDPNYLVGANCVSVLIDHF

SEQ ID NO: 155 - protein, 1692 aa, Homo sapiens
MERNTFSMDCHSKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRVVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCASMTPDGWSFALKSSDSSSGDPKTWQNKCLPGDPNYLVGANCVSVLIDHF

SEQ ID NO: 156 - protein, 1768 aa, Homo sapiens
MSARAAAAKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRVVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQKAEASSPVPYLSPETNPASSTSAVNHNVNLTNVRLEEPTPAPSTSYSPQADSLRTPSTEAAHIMLRDQEPSLSSHVDPTKVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCASMTPDGWSFALKSSDSSSGDPKTWQNKCLPGDPNYLVGANCVSVLIDHF

SEQ ID NO: 157 - protein, 1841 aa, Homo sapiens
MRRLEGLCLRRRRRRRGPARERSGDKMKYQKYLTVLQMAIGVTPSNRGSLLPLKRKLWVTPSSENPNGATSSVSQGKPSLRRIKGRLHRSKSLDSMDFCELTSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRVVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQKAEASSPVPYLSPETNPASSTSAVNHNVNLTNVRLEEPTPAPSTSYSPQADSLRTPSTEAAHIMLRDQEPSLSSHVDPTKVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCDPKTWQNKCLPGDPNYLVGANCVSVLIDHF

SEQ ID NO: 158 - protein, 1759 aa, Homo sapiens
MERNTFSMDCHSKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRVVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQKAEASSPVPYLSPETNPASSTSAVNHNVNLTNVRLEEPTPAPSTSYSPQADSLRTPSTEAAHIMLRDQEPSLSSHVDPTKVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCASMTPDGDPKTWQNKCLPGDPNYLVGANCVSVLIDHF

SEQ ID NO: 159 - protein, 1755 aa, Homo sapiens
MSARAAAAKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRVVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQKAEASSPVPYLSPETNPASSTSAVNHNVNLTNVRLEEPTPAPSTSYSPQADSLRTPSTEAAHIMLRDQEPSLSSHVDPTKVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCASMTPDGDPKTWQNKCLPGDPNYLVGANCVSVLIDHF

SEQ ID NO: 160 - protein, 1688 aa, Homo sapiens
MSARAAAAKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRVVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCASMTPDGWSFALKSSDSSSGDPKTWQNKCLPGDPNYLVGANCVSVLIDHF

SEQ ID NO: 161 - protein, 1748 aa, Homo sapiens
MSARAAAAKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRVVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQKAEASSPVPYLSPETNPASSTSAVNHNVNLTNVRLEEPTPAPSTSYSPQADSLRTPSTEAAHIMLRDQEPSLSSHVDPTKVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCDPKTWQNKCLPGDPNYLVGANCVSVLIDHF

SEQ ID NO: 162 - protein, 1668 aa, Homo sapiens
MSARAAAAKSTAMEETAIWEQHTVTLHRAPGFGFGIAISGGRDNPHFQSGETSIVISDVLKGGPAEGQLQENDRVAMVNGVSMDNVEHAFAVQQLRKSGKNAKITIRRKKKVQIPVSRPDPEPVSDNEEDSYDEEIHDPRSGRSGVVNRRSEKIWPRDRSASRERSLSPRSDRRSVASSQPAKPTKVTLVKSRKNEEYGLRLASHIFVKEISQDSLAARDGNIQEGDVVLKINGTVTENMSLTDAKTLIERSKGKLKMVVQRDERATLLNVPDLSDSIHSANASERDDISEIQSLASDHSGRSHDRPPRRSRSRSPDQRSEPSDHSRHSPQQPSNGSLRSRDEERISKPGAVSTPVKHADDHTPKTVEEVTVERNEKQTPSLPEPKPVYAQVGQPDVDLPVSPSDGVLPNSTHEDGILRPSMKLVKFRKGDSVGLRLAGGNDVGIFVAGVLEDSPAAKEGLEEGDQILRVNNVDFTNIIREEAVLFLLDLPKGEEVTILAQKKKDVYRRIVESDVGDSFYIRTHFEYEKESPYGLSFNKGEVFRVVDTLYNGKLGSWLAIRIGKNHKEVERGIIPNKNRAEQLASVQYTLPKTAGGDRADFWRFRGLRSSKRNLRKSREDLSAQPVQTKFPAYERVVLREAGFLRPVTIFGPIADVAREKLAREEPDIYQIAKSEPRDAGTDQRSSGIIRLHTIKQIIDQDKHALLDVTPNAVDRLNYAQWYPIVVFLNPDSKQGVKTMRMRLCPESRKSARKLYERSHKLRKNNHHLFTTTINLNSMNDGWYGALKEAIQQQQNQLVWVSEGKADGATSDDLDLHDDRLSYLSAPGSEYSMYSTDSRHTSDYEDTDTEGGAYTDQELDETLNDEVGTPPESAITRSSEPVREDSSGMHHENQTYPPYSPQAQPQPIHRIDSPGFKPASQQVYRKDPYPEEMMRQNHVLKQPAVSHPGHRPDKEPNLTYEPQLPYVEKQASRDLEQPTYRYESSSYTDQFSRNYEHRLRYEDRVPMYEEQWSYYDDKQPYPSRPPFDNQHSQDLDSRQHPEESSERGYFPRFEEPAPLSYDSRPRYEQAPRASALRHEEQPAPGYDTHGRLRPEAQPHPSAGPKPAESKQYFEQYSRSYEQVPPQGFTSRAGHFEPLHGAAAVPPLIPSSQHKPEALPSNTKPLPPPPTQTEEEEDPAMKPQSVLTRVKMFENKRSASLETKKDVNDTGSFKPPEVASKPSGAPIIGPKPTSQNQFSEHDKTLYRIPEPQKPQLKPPEDIVRSNHYDPEEDEEYYRKQLSYFDRRSFENKPPAHIAASHLSEPAKPAHSQNQSNFSSYSSKGKPPEADGVDRSFGEKRYEPIQATPPPPPLPSQYAQPSQPVTSASLHIHSKGAHGEGNSVSLDFQNSLVSKPDPPPSQNKPATFRPPNREDTAQAAFYPQKSFPDKAPVNGTEQTQKTVTPAYNRFTPKPYTSSARPFERKFESPKFNHNLLPSETAHKPDLSSKTPTSPKTLVKSHSLAQPPEFDSGVETFSIHAEKPKYQINNISTVPKAIPVSPSAVEEDEDEDGHTVVATARGIFNSNGGVLSSIETGVSIIIPQGAIPEGVEQEIYFKVCRDNSILPPLDKEKGETLLSPLVMCGPHGLKFLKPVELRLPHCDPKTWQNKCLPGDPNYLVGANCVSVLIDHF

SEQ ID NO: 163 - protein, 848 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 164 - protein, 761 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVHSPPPPASASSSTPVPLSPPDTTWPLPALATTEPAKGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPATLGGNSASYTFVSLLFSAVTLLLLC

SEQ ID NO: 165 - protein, 884 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQEVHAPWNWQVGRQKGQAGSAGFPGSHETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 166 - protein, 726 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPATLGGNSASYTFVSLLFSAVTLLLLC

SEQ ID NO: 167 - protein, 735 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVREPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPATLGGNSASYTFVSLLFSAVTLLLLC

SEQ ID NO: 168 - protein, 857 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVREPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 169 - protein, 725 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVREPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPATLGGNSASYTFVSLLFSAVTLLLLC

SEQ ID NO: 170 - protein, 847 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVREPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 171 - protein, 858 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 172 - protein, 875 aa, Homo sapiens
MFLLRRYVCIFTEKLKNQAELYVFLSVKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHLRAHAVDINGNQVENPIDIVINVIDMNDNRPEFLHQVWNGTVPEGSKPGTYVMTVTAIDADDPNALNGMLRYRIVSQAPSTPSPNMFTINNETGDIITVAAGLDREKVQQYTLIIQATDMEGNPTYGLSNTATAVITVTDVNDNPPEFTAMTFYGEVPENRVDIIVANLTVTDKDQPHTPAWNAVYRISGGDPTGRFAIQTDPNSNDGLVTVVKPIDFETNRMFVLTVAAENQVPLAKGIQHPPQSTATVSVTVIDVNENPYFAPNPKIIRQEEGLHAGTMLTTFTAQDPDRYMQQNIRYTKLSDPANWLKIDPVNGQITTIAVLDRESPNVKNNIYNATFLASDNGIPPMSGTGTLQIYLLDINDNAPQVLPQEAETCETPDPNSINITALDYDIDPNAGPFAFDLPLSPVTIKRNWTITRLNGDFAQLNLKIKFLEAGIYEVPIIITDSGNPPKSNISILRVKVCQCDSNGDCTDVDRIVGAGLGTGAIIAILLCIIILLILVLMFVVWMKRRDKERQAKQLLIDPEDDVRDNILKYDEEGGGEEDQDYDLSQLQQPDTVEPDAIKPVGIRRMDERPIHAEPQYPVRSAAPHPGDIGDFINEGLKAADNDPTAPPYDSLLVFDYEGSGSTAGSLSSLNSSSSGGEQDYDYLNDWGPRFKKLADMYGGGDD

SEQ ID NO: 173 - protein, 906 aa, Homo sapiens
MCRIAGALRTLLPLLAALLQASVEASGEIALCKTGFPEDVYSAVLSKDVHEGQPLLNVKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHLRAHAVDINGNQVENPIDIVINVIDMNDNRPEFLHQVWNGTVPEGSKPGTYVMTVTAIDADDPNALNGMLRYRIVSQAPSTPSPNMFTINNETGDIITVAAGLDREKVQQYTLIIQATDMEGNPTYGLSNTATAVITVTDVNDNPPEFTAMTFYGEVPENRVDIIVANLTVTDKDQPHTPAWNAVYRISGGDPTGRFAIQTDPNSNDGLVTVVKPIDFETNRMFVLTVAAENQVPLAKGIQHPPQSTATVSVTVIDVNENPYFAPNPKIIRQEEGLHAGTMLTTFTAQDPDRYMQQNIRYTKLSDPANWLKIDPVNGQITTIAVLDRESPNVKNNIYNATFLASDNGIPPMSGTGTLQIYLLDINDNAPQVLPQEAETCETPDPNSINITALDYDIDPNAGPFAFDLPLSPVTIKRNWTITRLNGDFAQLNLKIKFLEAGIYEVPIIITDSGNPPKSNISILRVKVCQCDSNGDCTDVDRIVGAGLGTGAIIAILLCIIILLILVLMFVVWMKRRDKERQAKQLLIDPEDDVRDNILKYDEEGGGEEDQDYDLSQLQQPDTVEPDAIKPVGIRRMDERPIHAEPQYPVRSAAPHPGDIGDFINEGLKAADNDPTAPPYDSLLVFDYEGSGSTAGSLSSLNSSSSGGEQDYDYLNDWGPRFKKLADMYGGGDD

SEQ ID NO: 174 - protein, 1079 aa, Homo sapiens
MEDEAVLDRGASFLKHVCDEEEVEGHHTIYIGVHVPKSYRRRRRHKRKTGHKEKKEKERISENYSDKSDIENADESSSSILKPLISPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKKGAGYHLDLFWVAILMVICSLMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDSDCPYSEKVPSIKIPMDIMEQQPFLSDSKPSDRERSPTFLERHTSC

SEQ ID NO: 175 - protein, 1094 aa, Homo sapiens
MEDEAVLDRGASFLKHVCDEEEVEGHHTIYIGVHVPKSYRRRRRHKRKTGHKEKKEKERISENYSDKSDIENADESSSSILKPLISPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKKGAGYHLDLFWVAILMVICSLMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDEKDHQHSLNATHHADKIPFLQSLGMPSPPRTPVKVVPQIRIELEPEDNDYFWRSKGTETTL

SEQ ID NO: 176 - protein, 1035 aa, Homo sapiens
MSTENVEGKPSNLGERGRARSSTFLRVVQPMFNHSIFTSAVSPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKKGAGYHLDLFWVAILMVICSLMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDSDCPYSEKVPSIKIPMDIMEQQPFLSDSKPSDRERSPTFLERHTSC

SEQ ID NO: 177 - protein, 570 aa, Homo sapiens
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSANENREKVNDQAKLIVGIVVGLLLAALVAGVVYWLYMKKSKTASKHVNKDLGNMEENKKLEENNHKTEA

SEQ ID NO: 178 - protein, 555 aa, Homo sapiens
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSK

SEQ ID NO: 179 - protein, 133 aa, Homo sapiens
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFSK

SEQ ID NO: 180 - protein, 583 aa, Homo sapiens
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 181 - protein, 757 aa, Homo sapiens
MLLRLLLAWAAAGPTLGQDPWAAEPRAACGPSSCYALFPRRRTFLEAWRACRELGGDLATPRTPEEAQRVDSLVGAGPASRLLWIGLQRQARQCQLQRPLRGFTWTTGDQDTAFTNWAQPASGGPCPAQRCVALEASGEHRWLEGSCTLAVDGYLCQFGFEGACPALQDEAGQAGPAVYTTPFHLVSTEFEWLPFGSVAAVQCQAGRGASLLCVKQPEGGVGWSRAGPLCLGTGCSPDNGGCEHECVEEVDGHVSCRCTEGFRLAADGRSCEDPCAQAPCEQQCEPGGPQGYSCHCRLGFRPAEDDPHRCVDTDECQIAGVCQQMCVNYVGGFECYCSEGHELEADGISCSPAGAMGAQASQDLGDELLDDGEDEEDEDEAWKAFNGGWTEMPGILWMEPTQPPDFALAYRPSFPEDREPQIPYPEPTWPPPLSAPRVPYHSSVLSVTRPVVVSATHPTLPSAHQPPVIPATHPALSRDHQIPVIAANYPDLPSAYQPGILSVSHSAQPPAHQPPMISTKYPELFPAHQSPMFPDTRVAGTQTTTHLPGIPPNHAPLVTTLGAQLPPQAPDALVLRTQATQLPIIPTAQPSLTTTSRSPVSPAHQISVPAATQPAALPTLLPSQSPTNQTSPISPTHPHSKAPQIPREDGPSPKLALWLPSPAPTAAPTALGEAGLAEHSQRDDRWLLVALLVPTCVFLVVLLALGIVYCTRCGPHAPNKRITDCYRWVIHAGSKSPTEPMPPRGSLTGVQTCRTSV

SEQ ID NO: 182 - protein, 21 aa, Homo sapiens
GSGEGRGSLLTCGDVEENPGP

SEQ ID NO: 183 - protein, 22 aa, Homo sapiens
GSGATNFSLLKQAGDVEENPGP

SEQ ID NO: 184 - protein, 23 aa, Homo sapiens
GSGQCTNYALLKLAGDVESNPGP

SEQ ID NO: 185 - protein, 25 aa, Homo sapiens
GSGVKQTLNFDLLKLAGDVESNPGP

The invention claimed is:

1. A population of corneal endothelial cells comprising increased expression levels of PITX2 and at least one additional transcription factor selected from the group consisting of FOXC1, TFAP2B, LMX1B, and POU6F2 relative to endogenous expression levels of PITX2 and the at least one additional transcription factor in the population of corneal endothelial cells, wherein the increased expression comprises exogenous expression of PITX2 and the at least one additional transcription factor.

2. The population of corneal endothelial cells of claim 1, wherein the corneal endothelial cells are mature corneal endothelial cells.

3. The population of corneal endothelial cells of claim 1, comprising increased expression levels of PITX2 and FOXC1 relative to endogenous expression levels of PITX2 and FOXC1 in the population of corneal endothelial cells.

4. The population of corneal endothelial cells of claim 1, comprising increased expression levels of PITX2 and TFAP2B relative to endogenous expression levels of PITX2 and TFAP2B in the population of corneal endothelial cells.

5. The population of corneal endothelial cells of claim 1, comprising increased expression levels of PITX2 and LMX1B relative to endogenous expression levels of PITX2 and LMX1B in the population of corneal endothelial cells.

6. The population of corneal endothelial cells of claim 1, comprising increased expression levels of PITX2 and POU6F2 relative to endogenous expression levels of PITX2 and POU6F2 in the population of corneal endothelial cells.

7. The population of corneal endothelial cells of claim 1, wherein the corneal endothelial cells exhibit an increased expression of one or more markers selected from the group consisting of: COL8A1, COL8A2, SLC4A11 and MRGPRX3 relative to corneal endothelial progenitors.

8. The population of corneal endothelial cells of claim 1, wherein the corneal endothelial cells comprise an expression vector comprising a nucleic acid encoding PITX2 and the at least one additional transcription factor.

9. The population of corneal endothelial cells of claim 1, wherein (i) the increased expression of PITX2 comprises an increase of at least 0.1-fold, 0.2-fold, 0.5-fold, 1-fold, 2-fold, 5-fold, 10-fold, 20-fold, 50-fold, 100-fold, 200-fold, 500-fold, 1,000-fold, or 10,000-fold relative to endogenous expression levels of PITX2 in the population of corneal endothelial cells, and (ii) the increased expression of the at least one additional transcription factor comprises an increase of at least 0.1-fold, 0.2-fold, 0.5-fold, 1-fold, 2-fold, 5-fold, 10-fold, 20-fold, 50-fold, 100-fold, 200-fold, 500-fold, 1,000-fold, or 10,000-fold relative to endogenous expression levels of the at least one additional transcription factor in the population of corneal endothelial cells.

10. The population of corneal endothelial cells of claim 1, wherein the population of corneal endothelial cells comprises at least $10^6$ corneal endothelial cells.

11. The population of corneal endothelial cells of claim 8, wherein the expression vector is a viral vector selected from the group consisting of an adeno-associated virus (AAV) vector, an adenovirus vector, a lentivirus vector, a herpes simplex virus vector, a sendai virus vector, and a retrovirus vector.

12. The population of corneal endothelial cells of claim 8, wherein the expression vector is a non-viral vector selected from the group consisting of a plasmid DNA, a linear double-stranded DNA (dsDNA), a linear single-stranded DNA (ssDNA), a nanoplasmid, a minicircle DNA, a single-stranded oligodeoxynucleotide (ssODN), a DDNA oligonucleotide, a single-stranded mRNA (ssRNA), and a double-stranded mRNA (dsRNA).

13. The population of corneal endothelial cells of claim 8, wherein the expression vector is a non-viral vector comprising a naked nucleic acid, a liposome, a dendrimer, a nanoparticle, a lipid-polymer system, a solid lipid nanoparticle, and/or a liposome protamine/DNA lipoplex (LPD).

14. The population of corneal endothelial cells of claim 8, wherein the expression vector comprises a promoter operably linked to a nucleic acid encoding PITX2 and the at least one additional transcription factor.

15. A cell comprising an expression vector comprising a nucleic acid encoding PITX2 and at least one additional transcription factor selected from the group consisting of FOXC1, TFAP2B, LMX1B and POU6F2, wherein the cell is a pluripotent stem cell or a corneal endothelial cell.

16. The cell of claim 15, wherein the expression vector is a viral vector.

17. The cell of claim 15, wherein the expression vector is a non-viral vector.

18. The cell of claim 15, wherein the expression vector is an inducible expression vector.

19. The cell of claim 15, wherein the expression vector comprises a promoter operably linked to a nucleic acid encoding the at least one transcription factor.

20. The cell of claim 15, wherein the cell is a pluripotent stem cell.

* * * * *